US008129348B2

(12) United States Patent
Besman et al.

(10) Patent No.: US 8,129,348 B2
(45) Date of Patent: Mar. 6, 2012

(54) CONJUGATES OF BIOLOGICALLY ACTIVE PROTEINS HAVING A MODIFIED IN VIVO HALF-LIFE

(75) Inventors: Marc Besman, Seattle, WA (US); Stewart Chipman, Bainbridge Island, WA (US); David Leung, Mercer Island, WA (US); Jack Singer, Seattle, WA (US)

(73) Assignee: Cell Therapeutics, Inc., Seattle, WA (US)

( * ) Notice: Subject to any disclaimer, the term of this patent is extended or adjusted under 35 U.S.C. 154(b) by 457 days.

(21) Appl. No.: 12/251,324

(22) Filed: Oct. 14, 2008

(65) Prior Publication Data

US 2009/0298762 A1 Dec. 3, 2009

Related U.S. Application Data

(63) Continuation of application No. 11/880,377, filed on Jul. 20, 2007, now abandoned, which is a continuation of application No. PCT/US2006/002501, filed on Jan. 25, 2006.

(60) Provisional application No. 60/712,585, filed on Aug. 30, 2005, provisional application No. 60/647,119, filed on Jan. 25, 2005.

(51) Int. Cl.

| | |
|---|---|
| ***A61K 38/16*** | (2006.01) |
| ***A61K 38/14*** | (2006.01) |
| ***C07K 14/00*** | (2006.01) |

(52) U.S. Cl. ....... 514/21.2; 530/350; 530/395; 514/20.9

(58) Field of Classification Search ........................ None
See application file for complete search history.

(56) References Cited

U.S. PATENT DOCUMENTS

| | | | |
|---|---|---|---|
| 4,810,643 | A | 3/1989 | Souza |
| 5,985,265 | A | 11/1999 | Kinstler et al. |
| 6,583,272 | B1 | 6/2003 | Bailon |
| 6,831,158 | B2 | 12/2004 | Nissen et al. |

FOREIGN PATENT DOCUMENTS

| | | | |
|---|---|---|---|
| JP | 4 503 606 | T | 7/1992 |
| JP | 2002/516610 | A | 6/2002 |
| WO | 90/09800 | A1 | 9/1990 |
| WO | 98/49198 | A1 | 11/1998 |
| WO | WO02/02597 | | 1/2002 |

OTHER PUBLICATIONS

Egrie et al., "Characterization and biological effects of recombinant human erythropoietin," *Immunobiol.* 172:213-224 (1986).

Elliott et al., "Enhancement of therapeutic protein in vivo activities through glycoengineering," *Nature Biotechnology* 21:414-421 (2003).

Krantz, "Erythropoietin," *Blood* 77:419-434 (1991).

Lord et al., "Kinetics of neutrophil production in normal and neutropenic animals during the response to filgrastim (r-metHu G-CSF) or filgrastim SD/01 (PEG-r-metHu G-CSF)," *Clin. Cancer Res.* 7:2085-2090 (2001).

Perlman et al., "Glycosylation of an N-Terminal Extension Prolongs the Half-Life and Increases the in vivo activity of follicle stimulating hormone," *J. Clin. Endocrinol. Metabol.* 88:3227-3235 (2003).

Sasaki et al., "Carbohydrate structure of erythropoietin expressed in Chinese hamster ovary cells by a human erythropoietin cDNA," *J. Biol. Chem.* 262:12059-12076 (1987).

Van Der Auwera et al., "Pharmacodynamics and pharmacokinetics of single doses of subcutaneous pegylated human G-CSF mutant (Ro 25-8315) in healthy volunteers: comparison with single and multiple daily doses of filgrastim," *Am. J. Hematol.* 66:245-251 (2001).

*Primary Examiner* — Christine J Saoud
*Assistant Examiner* — Jegatheesan Seharaseyon
(74) *Attorney, Agent, or Firm* — Christensen O'Connor Johnson Kindness PLLC

(57) ABSTRACT

Disclosed are biologically active protein conjugates that comprise a biologically active polypeptide coupled via a peptide bond to a polypeptide comprising from 2 to about 500 units of a repeating peptide motif, wherein the biologically active protein conjugate exhibits a modified plasma half-life compared to the intrinsic half-life of the unconjugated biologically active polypeptide or protein. Also disclosed are methods of making and using the conjugated proteins, as well as methods for determining whether a given conjugate exhibits a modified half life relative to the intrinsic half life of the unconjugated polypeptide.

9 Claims, 6 Drawing Sheets

CONJUGATES OF BIOLOGICALLY ACTIVE PROTEINS HAVING A MODIFIED IN VIVO HALF-LIFE

CROSS-REFERENCE TO RELATED APPLICATIONS

This application is a continuation of U.S. application Ser. No. 11/880,377, filed Jul. 20, 2007 now abandoned, which is a continuation of International Application No. PCT/US2006/002501, filed Jan. 25, 2006, published in English, which claims priority under 35 U.S.C 119(e) from U.S. Provisional Application No. 60/712,585, filed Aug. 30, 2005, and U.S. Provisional Application No. 60/647,119, filed Jan. 25, 2005, all of which are incorporated by reference herein.

TECHNICAL FIELD

This invention relates generally to biologically active proteins, and more specifically to altering the half-life of biologically active proteins.

SEQUENCE LISTING

The sequence listing associated with this application is provided in text format in lieu of a paper copy and is hereby incorporated by reference into the specification. The name of the text file containing the sequence listing is 35184_Sequence.txt. The text file is 2.03 MB; was created on Jul. 19, 2011; and has been submitted via EFS-Web.

BACKGROUND OF THE INVENTION

Biologically active proteins often have undesirable half-lives when administered as human therapeutics. Their intrinsic half-lives impose administration schedules and dosing regimens that often result in less than optimal therapeutic efficacy, compliance problems and patient inconvenience.

In the manufacture of biologically active proteins for human therapeutics, the extension of the half-life of biologically active proteins has been attempted through physical means (e.g., altered route of administration, nanoparticle encapsulation and liposomal entrapment), chemical modification (e.g., emulsions, pegylation and hyperglycosylation) and genetic modification (e.g., modification of primary protein structure, polymer tags, human serum albumin fusion, incorporation of post-translational modification). See, for example, Lord, et al., Clin. Cancer Res. 7:2085-2090 (2001), and van Der Auwera, et al., Am. J. Hematol. 66:245-251 (2001). However, such approaches have resulted in other problems. Extension of biologically active protein half-life through physical means often introduces increased drug substance complexity with costly and time-consuming additional downstream processes during manufacturing. Chemical modification may alter the biological activity or safety profile of the biologically active protein. Where biologically active proteins are made via recombinant DNA synthesis methodology, the effect of the genetic modification on protein yield and purity in the particular cellular expression systems issues needs to be assessed for its intended use.

Accordingly, there is a need for other approaches for modifying the intrinsic half-life of biologically active proteins.

SUMMARY OF THE INVENTION

One aspect of the present invention is directed to a protein conjugate comprising a biologically active polypeptide coupled via a peptide bond to a polypeptide (amino acid extension) that comprises from 2 to about 500 repeating units of a peptide motif. The motif comprises a major constituent and a minor constituent, in which the major constituent is two or more residues of one amino acid selected from Gly (G), Asn (N) and Gln (Q), and the minor constituent is one or more residues of one amino acid selected from Ala (A), Ser (S), Thr (T), Asp (D), Gln (Q), Glu (E), His (H) and Asn (N), with the proviso that none of the amino acids is present in both the major constituent and said minor constituent, wherein the plasma half-life of the conjugate is modified relative to the intrinsic half-life of the unconjugated biologically active polypeptide. The term "modified", as used herein, refers to an increased or a decreased half-life relative to the plasma half-life of the unconjugated biologically active polypeptide or protein itself (i.e., the intrinsic half life). By the phrase "intrinsic half-life" it is meant the half-life of the native biologically active polypeptide or the half-life of the polypeptide in unconjugated form (thus including recombinant forms of the native polypeptide).

In some embodiments, the peptide motif comprises 3-6 amino acid residues (i.e., 3, 4, 5 or 6). In some embodiments, wherein the peptide motif contains 5 or 6 amino acid residues, the minor constituent comprises 1 amino acid residue of said peptide. In some embodiments, the peptide motif has a sequence consisting of N and T amino acid residues, N and E amino acid residues, Q and S amino acid residues, or N and Q amino acid residues. In some embodiments, the amino acid extension is N-terminal with respect to said biologically active polypeptide; in some embodiments, it is C-terminal with respect to said biologically active polypeptide; and in other embodiments, it is situated at both the N and C-terminus with respect to said biologically active polypeptide. In some embodiments, the biologically active polypeptide is a cytokine (e.g., granulocyte colony stimulating factor (G-CSF), human growth hormone, or an interferon such as a beta-interferon or a gamma-interferon), an antibody, antibody fragment, proteolytic antibody fragment or domain, single chain antibody, genetically or chemically optimized antibody or fragment thereof, a soluble gp120 or gp160 glycoprotein, a coagulation factor, a soluble receptor such as a tumor necrosis factor (TNF)-$\alpha$ type II receptor, a therapeutic enzyme or erythropoietin (EPO). In some embodiments, the protein conjugate has a modified half-life that is decreased relative to the intrinsic half-life of the unconjugated biologically active polypeptide, e.g., wherein said biologically active polypeptide comprises a recombinant activated protein C or a recombinant Factor VII.

Another aspect of the present invention is directed to a composition comprising the protein conjugate and a carrier. In some embodiments, the composition is a pharmaceutical composition and the carrier is a pharmaceutically acceptable carrier.

Another aspect of the present invention is directed to a chimeric DNA molecule that encodes the protein conjugate described above, as well as a vector, together comprising the chimeric DNA molecule, and a cell transformed with the chimeric DNA molecule or a vector containing it. In some embodiments, the vector is a plasmid, e.g., pCE2. In some embodiments, the cell is a mammalian cell e.g., a Chinese hamster ovary (CHO) cell, or a bacterium e.g., *E. coli*, or yeast.

Yet another aspect of the present invention is directed to a method of making a biologically active protein conjugate comprising a biologically active polypeptide coupled via peptide bond to a polypeptide comprising from 2 to about 500 units of a peptide comprising as a major constituent, two or more residues of one amino acid selected from Gly (G), Asn (N) and Gln (Q), and as a minor constituent, one or more residues of one amino acid selected from Ala (A), Ser (S), Thr (T), Asp (D), Gln (Q), Glu (E), His (H) and Asn (N), provided that none of said amino acids is present in said major constituent and said minor constituent, such that said biologically active protein has a modified plasma half-life compared to intrinsic half-life of the unconjugated biologically active polypeptide, said method comprising: culturing a cell transformed with a chimeric DNA molecule encoding said protein conjugate under conditions whereby said DNA is expressed, thereby producing said protein conjugate; and extracting an expression product of said chimeric DNA molecule from said cell.

A further aspect of the present invention is directed to a method of determining whether a given protein conjugate exhibits a modified plasma half-life compared to the intrinsic half-life of the unconjugated biologically active polypeptide, comprising: a) preparing a protein conjugate comprising a biologically active polypeptide coupled via a peptide bond to a polypeptide that comprises from 2 to about 500 repeating units of a peptide motif, wherein the motif comprises a major constituent and a minor constituent, in which the major constituent comprises or consists of two or more residues of one amino acid selected from the group consisting of Gly (G), Asn (N) and Gln (Q), and the minor constituent comprises or consists of one or more residues of one amino acid selected from the group consisting of Ala (A), Ser (S), Thr (T), Asp (D), Gln (Q), Glu (E), His (H) and Asn (N), wherein none of the amino acids is present in both the major constituent and said minor constituent, and b) testing the protein conjugate to determine whether the protein conjugate has a modified plasma half-life compared to the intrinsic half-life of the unconjugated biologically active polypeptide.

DETAILED DESCRIPTION

Figure 1:
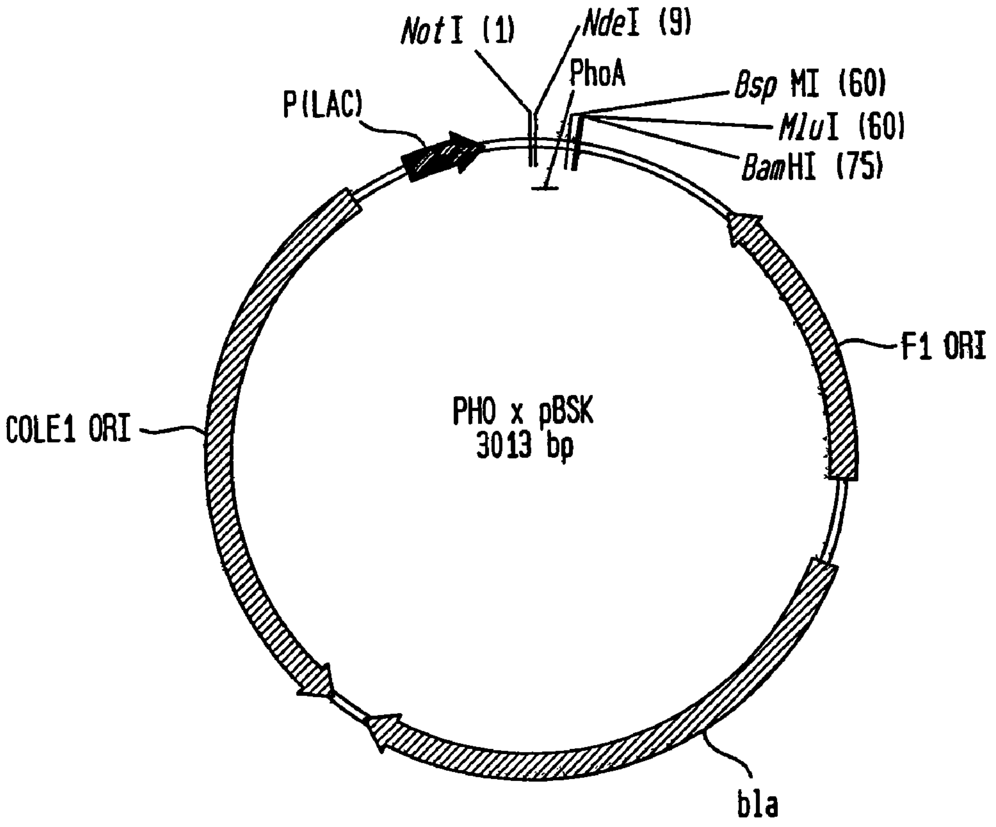
FIG. 1 is a schematic representation of the PHO x pBSK vector.

As used herein, the term "polypeptide" means a polymer of amino acids having no specific length, unless otherwise specified. Thus, peptides and proteins are included in the definition of "polypeptide" and these terms are used interchangeably throughout the specification, as well as in the claims. The term "polypeptide" does not exclude post-translational modifications, such as polypeptides having covalent attachment of glycosyl groups, acetyl groups, phosphate groups, lipid groups, hydroxylation of proline or lysine, and the like. Also encompassed by this definition of "polypeptide" are homologs thereof.

The term "purified" as used herein means that the biologically active protein conjugate has been purified to a level adequate for its intended use.

The present invention is directed, in a general aspect, to a protein conjugate comprising a biologically active polypeptide coupled via peptide bond to a polypeptide that comprises from 2 to about 500 units of a peptide motif that contains a major constituent of two or more residues of one amino acid selected from Gly (G), Asn (N) and Gln (Q), and a minor constituent of one or more residues of one amino acid selected from Ala (A), Ser (S), Thr (T), Asp (D), Gln (Q), Glu (E), His (H) and Asn (N), provided that none of the amino acids is present as both a major constituent and minor constituent. The protein conjugates of the present invention have a plasma half-life greater than the corresponding unconjugated biologically active polypeptide or protein.

The repeating unit of the motif generally contains 3-7 (3, 4, 5, 6 or 7) amino acid residues. Representative peptide motifs having N (Asn) as the major constituent are described in Table 1.

Representative peptide motifs having G (Gly) as the major constituent are described in Table 2.

Representative peptide motifs having Q (Gln) as the major constituent are described in Table 3.

The number of the peptide motifs ranges from 2 to about 500. Thus, the motifs including the specific peptide motifs set forth herein, may be present in the polypeptide in the following number of units: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400

401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 and 500 (thus including any subrange thereof).

As described above, the polypeptide conjugated to the biologically active polypeptide may also be referred to as an amino acid or polyamino extension (hereinafter "amino acid extension") of the biologically active polypeptide. The amino acid extension may be situated at the N-terminus, at the C-terminus or at both the N- and C-termini, with respect to the biologically active polypeptide sequence.

Without intending to be bound by theory, Applicants believe that the amino acid extensions do not adopt stable conformations and as such, do not interfere with or otherwise influence the activity of the protein. Also, limiting the amino acid extension to two different amino acids is believed to reduce the chemical complexity of the amino acid extension, which helps minimize the potential for immunogenicity, as well as allowing for the modulation of physicochemical properties far more extensively than is possible through the use of just one type or kind of amino acid.

Broadly, the biologically active polypeptide includes any protein (including native polypeptides (i.e., as they exist in vivo)) or polypeptides produced recombinantly, such as recombinant human G-CSF (rh-G-CSF) for which a modified plasma half-life would be desirable from some standpoint, particularly from a therapeutic standpoint, meaning that when delivered to a vertebrate organism, treats, e.g., cures, ameliorates, or lessens the symptoms of, a given disease in that vertebrate, or alternatively, prolongs the life of the vertebrate by slowing the progress of a terminal disease. Types of biologically active proteins include cytokines, chemokines, lymphokines, ligands, receptors, hormones, apoptosis-inducing polypeptides, enzymes, antibodies and antibody fragments, and growth factors. Examples of receptors include TNF type I receptor, IL-1 receptor type II, IL-1 receptor antagonist, IL-4 receptor and any chemically or genetically modified soluble receptors. Examples of enzymes include activated protein C, factor VII, collagenase (e.g., marketed by Advance Biofactures Corporation under the name SANTYL®); agalsidase-beta (e.g., marketed by Genzyme under the name FABRAZYME®); dornase-alpha (e.g., marketed by Genentech under the name PULMOZYME®); alteplase (e.g., marketed by Genentech under the name ACTIVASE®); pegylated-asparaginase (e.g., marketed by Enzon under the name ONCASPAR®); asparaginase (e.g., marketed by Merck under the name ELSPAR®); and imiglucerase (e.g., marketed by Genzyme under the name CEREDASE®). Examples of specific polypeptides or proteins include, but are not limited to granulocyte macrophage colony stimulating factor (GM-CSF), granulocyte colony stimulating factor (G-CSF), macrophage colony stimulating factor (M-CSF), colony stimulating factor (CSF), interferon beta (IFN-β), interferon gamma (IFNγ), interferon gamma inducing factor I (IGIF), transforming growth factor beta (TGF-β), RANTES (regulated upon activation, normal T-cell expressed and presumably secreted), macrophage inflammatory proteins (e.g., MIP-1-α and MIP-1-β), *Leishmania* elongation initiating factor (LEIF), platelet derived growth factor (PDGF), tumor necrosis factor (TNF), growth factors, e.g., epidermal growth factor (EGF), vascular endothelial growth factor (VEGF), fibroblast growth factor, (FGF), nerve growth factor (NGF), brain derived neurotrophic factor (BDNF), neurotrophin-2 (NT-2), neurotrophin-3 (NT-3), neurotrophin-4 (NT-4), neurotrophin-5 (NT-5), glial cell line-derived neurotrophic factor (GDNF), ciliary neurotrophic factor (CNTF), TNF a type II receptor, erythropoietin (EPO), insulin and soluble glycoproteins e.g., gp120 and gp160 glycoproteins. The gp120 glycoprotein is a human immunodeficiency virus (HIV) envelope protein, and the gp160 glycoprotein is a known precursor to the gp120 glycoprotein.

In some embodiments, it is desirable to modify the half-life of a biologically active polypeptide such that it is decreased relative to the intrinsic half life, is desirable. Such embodiments include recombinant activated protein C (e.g., marketed by Eli Lilly under the name XIGRIS®) and Recombinant Factor VII (marketed by Novo Nordisk under the name NOVOSEVEN®).

Biologically active polypeptides may be used to treat diseases such as Parkinson's disease, cancer, and heart disease. In addition, therapeutic polypeptides may be used to treat autoimmune disorders such as multiple sclerosis; Sjogren's syndrome; sarcoidosis; insulin dependent diabetes mellitus; autoimmune thyroiditis; arthritis (e.g., osteoarthritis, rheumatoid arthritis, reactive arthritis, and psoriatic arthritis); ankylosing spondylitis; and scleroderma. Also, therapeutic polypeptides of the present invention can be used to treat acute and chronic inflammatory disorders, to promote increase in stature, to promote wound healing, and to prevent rejection after transplantation of cells, tissues, or organs.

In some preferred embodiments, the polypeptide is G-CSF. G-CSF induces rapid proliferation and release of neutrophilic granulocytes to the bloodstream, thereby providing a therapeutic effect in fighting infection. As explained in U.S. Pat. No. 6,831,158, recombinant human (rh)-G-CSF is generally used for treating various forms of leukopenia (a reduced level of white blood cells) and neutropenia (a reduced level of neutrophils). Leukopenia and neutropenia result in an increased susceptibility to various infections.

Commercial preparations of rh-G-CSF are available under the names filgrastim (GRAN® and NEUPOGEN®), lenograstim (NEUTROGIN® and GRANOCYTE®) and nartograstim (NEU-UP®). GRAN® and NEUPOGEN® are non-glycosylated and produced in recombinant *E. coli* cells. NEUTROGIN® and GRANOCYTE® are glycosylated and produced in recombinant CHO cells. NEU-UP® is non-glycosylated with five amino acids substituted at the N-terminal region of intact rh-G-CSF produced in recombinant *E. coli* cells.

Aside from G-CSF, per se, G-CSF analogs that are biologically functional or have biological activity are also useful. Methods of preparing rh-G-CSF are disclosed in U.S. Pat. No. 4,810,643. Various G-CSF analogs are also reported in U.S. Pat. No. 4,810,643. The polynucleotide encoding rh-G-CSF and the amino acid structure of rh-G-CSF are both provided in U.S. Pat. No. 5,985,265.

A representative example of an amino acid sequence (SEQ ID NO: 2450) (and the corresponding polynucleotide sequence (SEQ ID NO: 2451)) of a protein conjugate of the present invention is shown in Table 4. The PHO leader sequence is included.

In the amino acid sequence, the PHO leader sequence is from amino acids 1 to 18, G-CSF is from amino acids 19 to 192, and the NNT155 amino acid extension (NNT155 disclosed as SEQ ID NO: 2) is from amino acids 193 to 347. The stop codon is denoted by the "*" symbol.

As depicted in the polynucleotide sequence (SEQ ID NO: 2451), nucleic acids 1 to 54 encode the PHO leader sequence, nucleic acids 55 to 576 encode G-CSF, and nucleic acids 577 to 1041 encode the NNT155 amino acid extension (NNT155 disclosed as SEQ ID NO: 2). Nucleic acids 1042 to 1044 (TAG) constitute the stop codon.

In some embodiments, the number of repeating peptide units is between 75 and 225. Thus, in the case of a protein conjugate containing G-CSF linked to a polypeptide containing repeating units of peptide motif having the sequence NNT, embodiments of the present invention may include any of the following protein conjugates ($(NNT)_{75}$-$(NNT)_{225}$ disclosed as SEQ ID NOS: 4-83, 4748 and 84-153, respectively, in order of appearance): G-CSF-$(NNT)_{75}$, G-CSF-$(NNT)_{76}$, G-CSF-$(NNT)_{77}$, G-CSF-$(NNT)_{78}$, G-CSF-$(NNT)_{79}$, G-CSF-$(NNT)_{80}$, G-CSF-$(NNT)_{81}$, G-CSF-$(NNT)_{82}$, G-CSF-$(NNT)_{83}$, G-CSF-$(NNT)_{84}$, G-CSF-$(NNT)_{85}$, G-CSF-$(NNT)_{86}$, G-CSF-$(NNT)_{87}$, G-CSF-$(NNT)_{88}$, G-CSF-$(NNT)_{89}$, G-CSF-$(NNT)_{90}$, G-CSF-$(NNT)_{91}$, G-CSF-$(NNT)_{92}$, G-CSF-$(NNT)_{93}$, G-CSF-$(NNT)_{94}$, G-CSF-$(NNT)_{95}$, G-CSF-$(NNT)_{96}$, G-CSF-$(NNT)_{97}$, G-CSF-$(NNT)_{98}$, G-CSF-$(NNT)_{99}$, G-CSF-$(NNT)_{100}$, G-CSF-$(NNT)_{101}$, G-CSF-$(NNT)_{102}$, G-CSF-$(NNT)_{103}$, G-CSF-$(NNT)_{104}$, G-CSF-$(NNT)_{105}$, G-CSF-$(NNT)_{106}$, G-CSF-$(NNT)_{107}$, G-CSF-$(NNT)_{108}$, G-CSF-$(NNT)_{109}$, G-CSF-$(NNT)_{110}$, G-CSF-$(NNT)_{111}$, G-CSF-$(NNT)_{112}$, G-CSF-$(NNT)_{113}$, G-CSF-$(NNT)_{114}$, G-CSF-$(NNT)_{115}$, G-CSF-$(NNT)_{116}$, G-CSF-$(NNT)_{117}$, G-CSF-$(NNT)_{118}$, G-CSF-$(NNT)_{119}$, G-CSF-$(NNT)_{120}$, G-CSF-$(NNT)_{121}$, G-CSF-$(NNT)_{122}$, G-CSF-$(NNT)_{123}$, G-CSF-$(NNT)_{124}$, G-CSF-$(NNT)_{125}$, G-CSF-$(NNT)_{126}$, G-CSF-$(NNT)_{127}$, G-CSF-$(NNT)_{128}$, G-CSF-$(NNT)_{129}$, G-CSF-$(NNT)_{130}$, G-CSF-$(NNT)_{131}$, G-CSF-$(NNT)_{132}$, G-CSF-$(NNT)_{133}$, G-CSF-$(NNT)_{134}$, G-CSF-$(NNT)_{135}$, G-CSF-$(NNT)_{136}$, G-CSF-$(NNT)_{137}$, G-CSF-$(NNT)_{138}$, G-CSF-$(NNT)_{139}$, G-CSF-$(NNT)_{140}$, G-CSF-$(NNT)_{141}$, G-CSF-$(NNT)_{142}$, G-CSF-$(NNT)_{143}$, G-CSF-$(NNT)_{144}$, G-CSF-$(NNT)_{145}$, G-CSF-$(NNT)_{146}$, G-CSF-$(NNT)_{147}$, G-CSF-$(NNT)_{148}$, G-CSF-$(NNT)_{149}$, G-CSF-$(NNT)_{150}$, G-CSF-$(NNT)_{151}$, G-CSF-$(NNT)_{152}$, G-CSF-$(NNT)_{153}$, G-CSF-$(NNT)_{154}$, G-CSF-$(NNT)_{155}$, G-CSF-$(NNT)_{156}$, G-CSF-$(NNT)_{157}$, G-CSF-$(NNT)_{158}$, G-CSF-$(NNT)_{159}$, G-CSF-$(NNT)_{160}$, G-CSF-$(NNT)_{161}$, G-CSF-$(NNT)_{162}$, G-CSF-$(NNT)_{163}$, G-CSF-$(NNT)_{164}$, G-CSF-$(NNT)_{165}$, G-CSF-$(NNT)_{166}$, G-CSF-$(NNT)_{167}$, G-CSF-$(NNT)_{168}$, G-CSF-$(NNT)_{169}$, G-CSF-$(NNT)_{170}$, G-CSF-$(NNT)_{171}$, G-CSF-$(NNT)_{172}$, G-CSF-$(NNT)_{173}$, G-CSF-$(NNT)_{174}$, G-CSF-$(NNT)_{175}$, G-CSF-$(NNT)_{176}$, G-CSF-$(NNT)_{177}$, G-CSF-$(NNT)_{178}$, G-CSF-$(NNT)_{179}$, G-CSF-$(NNT)_{180}$, G-CSF-$(NNT)_{181}$, G-CSF-$(NNT)_{182}$, G-CSF-$(NNT)_{183}$, G-CSF-$(NNT)_{184}$, G-CSF-$(NNT)_{185}$, G-CSF-$(NNT)_{186}$, G-CSF-$(NNT)_{187}$, G-CSF-$(NNT)_{188}$, G-CSF-$(NNT)_{189}$, G-CSF-$(NNT)_{190}$, G-CSF-$(NNT)_{191}$, G-CSF-$(NNT)_{192}$, G-CSF-$(NNT)_{193}$, G-CSF-$(NNT)_{194}$, G-CSF-$(NNT)_{195}$, G-CSF-$(NNT)_{196}$, G-CSF-$(NNT)_{197}$, G-CSF-$(NNT)_{198}$, G-CSF-$(NNT)_{199}$, G-CSF-$(NNT)_{200}$, G-CSF-$(NNT)_{201}$, G-CSF-$(NNT)_{202}$, G-CSF-$(NNT)_{203}$, G-CSF-$(NNT)_{204}$, G-CSF-$(NNT)_{205}$, G-CSF-$(NNT)_{206}$, G-CSF-$(NNT)_{207}$, G-CSF-$(NNT)_{208}$, G-CSF-$(NNT)_{209}$, G-CSF-$(NNT)_{210}$, G-CSF-$(NNT)_{211}$, G-CSF-$(NNT)_{212}$, G-CSF-$(NNT)_{213}$, G-CSF-$(NNT)_{214}$, G-CSF-$(NNT)_{215}$, G-CSF-$(NNT)_{216}$, G-CSF-$(NNT)_{217}$, G-CSF-$(NNT)_{218}$, G-CSF-$(NNT)_{219}$, G-CSF-$(NNT)_{220}$, G-CSF-$(NNT)_{221}$, G-CSF-$(NNT)_{222}$, G-CSF-$(NNT)_{223}$, G-CSF-$(NNT)_{224}$ and G-CSF-$(NNT)_{225}$.

In other preferred embodiments, the polypeptide is EPO. As explained in Krantz, Blood 77:419 (1991), naturally occurring EPO stimulates the division and differentiation of committed erythoid progenitors in the bone marrow and exerts its biological activity by binding to receptors and erythroid precursors. EPO has been manufactured biosynthetically using recombinant technology as the product of a cloned human EPO (hEPO) gene inserted into and expressed in Chinese hamster ovary (CHO) cells. See Egrie, et al., Immunobiol. 72:213-224 (1986). The primary structure (i.e., amino acid sequence) of the predominant, fully processed form of hEPO is illustrated in U.S. Pat. No. 6,583,272. In EPO, there are two disulfide bridges between $Cys^7$-$Cys^{161}$ and $Cys^{29}$-$Cys^{33}$. The molecular weight of the polypeptide chain of EPO without the sugar moieties is 18,236 DA. In the intact EPO molecule, approximately 40% of the molecular weight is accounted for by carbohydrate groups that glycosylate the protein at glycosylation sites on the protein. See Sasaki, et al., J. Biol. Chem. 262:12059 (1987).

Because hEPO is essential in red blood formation, the hormone is useful in the treatment of blood disorders characterized by low or defective red blood cell production. Clinically, EPO is used in the treatment of anemia in chronic renal failure (CRF) patients. See Eschbach, et al., NEJM 316:73-78 (1987); Eschbach, et al., Ann. Intern. Med. 111:992 (1989); Egrie, et al., Kidney Intl. 33:262 (1988); and Lim et al., Ann. Intern. Med. 110:108-114 (1989). EPO has also been used for the treatment of anemia in Acquired Immune Deficiency Syndrome (AIDS) and cancer patients undergoing chemotherapy. See R. P. Danna, et al., Erythropoietin In Clinical Applications—An International Perspective 301-324 (M. B. Garnick, ed., Marcel Dekker 1990).

Amino acid and corresponding nucleotide sequences of EPO, as well as other biologically active polypeptides useful in the present invention, are set forth in Table 5. Two other amino acid sequences of EPO are set forth in Table 6.

The protein conjugate may further comprise one or more affinity tags. Generally, an affinity tag is a polypeptide segment that facilitates isolation, purification or detection of the fusion protein containing the affinity tag. In principle, any peptide or protein for which an antibody or other specific binding agent is available can be used as an affinity tag. Representative affinity tags include a poly-histidine tract, protein A (Nilsson, et al., EMBO J. 4:1075, (1985); Nilsson, et al., Methods Enzymol. 198:3, (1991)), glutathione S transferase (Smith et al., Gene 67:31 (1988)), maltose binding protein (Kellerman et al., Methods Enzymol. 90:459-463 (1982); Guan, et al., Gene 67:21-30 (1987)), Glu-Glu affinity tag (Grussenmeyer, et al., Proc. Natl. Acad. Sci. USA 82:7952-4 (1985); see oNDEPHO-1R), substance P, Flag™ peptide (Hopp, et al., Biotechnology 6:1204-10 (1988)), streptavidin binding peptide, thioredoxin, ubiquitin, cellulose binding protein, T7 polymerase, or other antigenic epitope or binding domain. See, in general, Ford, et al., Protein Expression and Purification 2:95-107 (1991). DNAs encoding affinity tags are available from commercial suppliers (e.g., Pharmacia Biotech, Piscataway, N.J.; New England Biolabs, Beverly, Mass.; and Eastman Kodak, New Haven, Conn.).

As in the case of the amino acid extension, the affinity tag may be situated at the N-terminal, C-terminal, or both N-terminal and C-terminal with respect to the biologically active polypeptide sequence.

The present invention is also directed to a method of making the protein conjugates. The method involves culturing a cell transformed with a chimeric DNA molecule encoding the protein conjugate under conditions whereby the DNA is expressed, thereby producing the protein conjugate; and extracting an expression product of the chimeric DNA molecule from the cell or culture medium (or a milieu from the cell culture). In contrast to protein conjugates formed by chemical means, e.g., the commercial product NEULASTA (PEG-G-CSF, which is a covalent conjugate of recombinant methionyl human G-CSF and monomethionyl polyethylene glycol), the conjugation in the present invention is performed recombinantly as opposed to through physical or chemical means, resulting in the production of the biologically active protein and the polypeptide as components of a continuous protein. A linker, e.g., about 10-20 amino acids in length, may be used to join the protein with the amino acid extension.

The chimeric DNA molecule includes a gene or polynucleotide fragment that encodes a protein portion and one or more gene fragments e.g., oligonucleotides that together encode the polypeptide or amino acid extension. Oligonucleotides encoding the peptide motifs contained in the amino acid extension (and which encode the peptide motifs specifically disclosed herein) are set forth in Table 7. (The one-letter symbols used in Table 7 are explained in Table 8.) The DNA molecules may further contain fragments that encode affinity tags, linkers, as well as 5' and 3' regulatory elements. The gene or polynucleotide that encodes a protein portion may be any gene or polynucleotide known to encode the desired protein or polypeptide of the protein portion. Such genes and polynucleotides, and the primers used to generate them, are protein or polypeptide specific and well known in the art. The ligated oligonucleotides encoding the polypeptide portion may be produced according to procedures set forth above and described in Example 1. The oligonucleotides may be of any length, but are preferably designed to avoid the use of repetitive DNA sequences that are known to inhibit transcription. For instance, ligated oligonucleotides containing combinations of two glutamate codons are less likely to adopt a structural configuration that impedes gene expression than a polynucleotide made up of only one glutamate codon. The chimeric DNA molecule encoding the protein conjugate of the present invention may be engineered to contain codons encoding methionine (M) and/or proline (P) amino acid at its 5' end to facilitate expression.

The conjugates of the present invention are made via standard recombinant techniques in molecular biology. In some embodiments, a gene or polynucleotide encoding the biologically active protein is first cloned into a construct, e.g., a plasmid or other vector. Then, the oligonucleotides that encode the repeating units of the polypeptide portion are cloned into the construct through a ligation or multimerization scheme, in which the oligonucleotides are ligated together to form a polynucleotide that encodes the polypeptide portion. In this manner, the oligonucleotides are added to the gene or polynucleotide that encodes the protein portion, thereby producing the chimeric DNA molecule within the construct. As an option, the chimeric DNA molecule may be transferred or cloned into another construct that is a more appropriate expression vector. At this point, a host cell capable of expressing the chimeric DNA molecule is transformed with the chimeric DNA molecule. The transformation may occur with or without the utilization of a carrier, such as an expression vector. Then, the transformed host cell is cultured under conditions suitable for expression of the chimeric DNA molecule, resulting in the encoding of the protein conjugate.

Methods of ligation or multimerization useful in the present invention are well known. See, Joseph Sambrook, et al., Molecular Cloning: A Laboratory Manual, $2^{nd}$ ed., 1.53 (Cold Spring Harbor Laboratory Press 1989).

The cloning process may take place through "directional cloning", which is well known in the art. Directional cloning refers to the insertion of a polynucleotide into a plasmid or vector in a specific and predefined orientation. Once cloned into a vector, a polynucleotide sequence can be lengthened at its 3' end or other polynucleotides inserted at its 5' and/or 3' ends. Such a design provides an efficient and relatively easy way to create large polymers without having to perform multiple rounds of ligation. The vector preferably contains restriction sites upstream of a cloned polynucleotide, but downstream of regulatory elements required for expression to facilitate the insertion of the second polynucleotide.

To facilitate directional cloning, "adapter oligonucleotides" may be ligated to the 5' and 3' ends of the chimeric DNA molecule encoding the protein conjugate. Preferably, the adapters contain restriction sites that are compatible with those present in the expression vector. The 3' adapter oligonucleotide may also comprise a stop codon to designate the end of the encoding sequence to which it is ligated. The oligonucleotides encoding the polypeptide portion are preferably added in excess of the adapter oligonucleotides to increase the likelihood that a long polynucleotide is generated after ligation.

The methodology is not limited to any particular cloning strategy. The skilled artisan may use any variety of cloning strategies to produce a construct that comprises a chimeric DNA molecule of the present invention.

The chimeric DNA molecule can be introduced into the host cells in accordance with known techniques well known to those skilled in the art. These techniques include, but are not limited to, transformation using calcium phosphate co-precipitated chimeric DNA molecules, lipidic reagent co-transfection (i.e., Lipofectamine™), electroporation, transduction by contacting the cells with a virus, or microinjection of the chimeric DNA molecules into the cells. The host cell can be a higher eukaryotic cell, such as a mammalian cell, or a lower eukaryotic cell, such as a yeast cell, or the host cell can be a prokaryotic cell, such as a bacterial cell. Suitable prokaryotic hosts for transformation include *E. coli, Bacillus subtilis, Salmonella typhimurium* and various species within the genera *Pseudomonas, Streptomyces*, and *Staphylococcus*, although others may also be employed as a matter of choice.

A wide variety of host/expression vector combinations are employed in expressing the protein conjugates of the present invention. Generally, recombinant expression vectors will include origins of replication and selectable markers permitting transformation of the host cell (e.g., dihydrofolate reductase or neomycin resistance for eukaryotic cell culture, or such as tetracycline or ampicillin resistance in *E. coli*, or the *S. cerevisiae* TRP1 gene), and a promoter derived from a highly-expressed gene to direct transcription of a downstream structural sequence. Such promoters can be derived from operons encoding glycolytic enzymes such as 3-phosphoglycerate kinase (PGK), A-factor, acid phosphatase, or heat shock proteins, among others. The heterologous structural sequence is assembled in appropriate phase with translation initiation and termination sequences, and in some embodiments, a leader sequence capable of directing secretion of translated protein conjugate. The vector will further comprise an origin of replication to ensure maintenance of the vector and to, if desirable, provide amplification within the host.

Useful expression vectors that can be used include, for example, segments of chromosomal, non-chromosomal and synthetic DNA sequences. Suitable vectors include, but are not limited to, derivatives of SV40 and pcDNA and known bacterial plasmids such as col EI, pCR1, pBR322, pMal-C2, pET, pGEX as described by Smith, et al., Gene 67:31-40 (1988), pMB9 and derivatives thereof, plasmids such as RP4, phage DNAs such as the numerous derivatives of phage I such as NM989, as well as other phage DNA such as M13 and filamentous single stranded phage DNA; yeast plasmids such as the 2 micron plasmid or derivatives of the 2m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. The requirements are that the vectors are replicable and viable in the host cell of choice. Low- or high-copy number vectors may be used as desired.

For example in a baculovirus expression system, both non-fusion transfer vectors, such as, but not limited to pVL941 (BamHI cloning site, available from Summers, et al., Virology 84:390-402 (1978)), pVL1393 (BamHI, SmaI, XbaI, EcoRI, NotI, XmaIII, BglII and PstI cloning sites; Invitrogen), pVL1392 (BglII, PstI, NotI, XmaIII, EcoRI, XbaII, SmaI and BamHI cloning site; Summers, et al., Virology 84:390-402 (1978) and Invitrogen) and pBlueBacIII (BamHI, BglII, PstI, NcoI and HindIII cloning site, with blue/white recombinant screening, Invitrogen), and fusion transfer vectors such as, but not limited to, pAc700 (BamHI and KpnI cloning sites, in which the BamHI recognition site begins with the initiation codon; Summers, et al., Virology 84:390-402 (1978)), pAc701 and pAc70-2 (same as pAc700, with different reading frames), pAc360 (BamHI cloning site 36 base pairs downstream of a polyhedrin initiation codon; Invitrogen (1995)) and pBlueBacHisA, B, C (three different reading frames with BamHI, BglII, PstI, NcoI and HindIII cloning site, an N-terminal peptide for ProBond™ purification and blue/white recombinant screening of plaques; Invitrogen (220) can be used.

Mammalian expression vectors will comprise an origin of replication, a suitable promoter and enhancer, and also any necessary ribosome binding sites, polyadenylation site, splice donor and acceptor sites, transcriptional termination sequences, and 5' flanking nontranscribed sequences. DNA sequences derived from the SV40 splice, and polyadenylation sites may be used to provide the required nontranscribed genetic elements. Mammalian expression vectors contemplated for use in the invention include vectors with inducible promoters, such as the dihydrofolate reductase promoters, any expression vector with a DHFR expression cassette or a DHFR/methotrexate co-amplification vector such as pED (PstI, SalI, SbaI, SmaI and EcoRI cloning sites, with the vector expressing both the cloned gene and DHFR; Randal J. Kaufman, 1991, Randal J. Kaufman, Current Protocols in Molecular Biology, 16, 12 (1991)). Alternatively a glutamine synthetase/methionine sulfoximine co-amplification vector, such as pEE14 (HindIII, XbaII, SmaI, SbaI, EcoRI and BclI cloning sites in which the vector expresses glutamine synthetase and the cloned gene; Celltech). A vector that directs episomal expression under the control of the Epstein Barr Virus (EBV) or nuclear antigen (EBNA) can be used such as pREP4 (BamHI, SfiI, XhoI, NotI, NheI, HindIII, NheI, PvuII and KpnI cloning sites, constitutive RSV-LTR promoter, hygromycin selectable marker; Invitrogen), pCEP4 (BamHI, SfiI, XhoI, NotI, NheI, HindIII, NheI, PvuII and KpnI cloning sites, constitutive hCMV immediate early gene promoter, hygromycin selectable marker; Invitrogen), pMEP4 (KpnI, PvuI, NheI, HindIII, NotI, XhoI, SfiI, BamHI cloning sites, inducible methallothionein IIa gene promoter, hygromycin selectable marker, Invitrogen), pREP8 (BamHI, XhoI, NotI, HindIII, NheI and KpnI cloning sites, RSV-LTR promoter, histidinol selectable marker; Invitrogen), pREP9 (KpnI, NheI, HindIII, NotI, XhoI, SfiI, BamHI cloning sites, RSV-LTR promoter, G418 selectable marker; Invitrogen), and pEBVHis (RSV-LTR promoter, hygromycin selectable marker, N-terminal peptide purifiable via ProBond™ resin and cleaved by enterokinase; Invitrogen).

Selectable mammalian expression vectors for use in the invention include, but are not limited to, pRc/CMV (HindIII, BstXI, NotI, SbaI and ApaI cloning sites, G418 selection, Invitrogen), pRc/RSV (HindII, SpeI, BstXI, NotI, XbaI cloning sites, G418 selection, Invitrogen) and the like. Vaccinia virus mammalian expression vectors (see, for example, Randall J. Kaufman, Current Protocols in Molecular Biology 16.12 (Frederick M. Ausubel, et al., eds. Wiley 1991) that can be used in the present invention include, but are not limited to, pSC11 (SmaI cloning site, TK- and β-gal selection), pMJ601 (SalI, SmaI, AflI, NarI, BspMII, BamHI, ApaI, NheI, SacII, KpnI and HindIII cloning sites; TK- and β-gal selection), pTKgptF1S (EcoRI, PstI, SalII, AccI, HindIII, SbaI, BamHI and Hpa cloning sites, TK or XPRT selection) and the like.

Yeast expression systems that can also be used in the present include, but are not limited to, the non-fusion pYES2 vector (XbaI, SphI, ShoI, NotI, GstXI, EcoRI, BstXI, BamHI, SacI, KpnI and HindIII cloning sites, Invitrogen), the fusion pYESHisA, B, C (XbaII, SphI, ShoI, NotI, BstXI, EcoRI, BamHI, SacI, KpnI and HindIII cloning sites, N-terminal peptide purified with ProBond™ resin and cleaved with enterokinase; Invitrogen), pRS vectors and the like.

One particularly preferred vector for use in the present invention is the plasmid pCE2. The pCE2 plasmid may be obtained by any method known in the art. One such method, which was utilized in Example 2.A., is described in Leung, et al., Proc. Natl. Acad. Sci. USA 92:4813-4817 (1995).

In a preferred embodiment, the chimeric DNA molecules can be inserted into an expression vector that already contains the necessary elements for the transcription and translation of the inserted chimeric DNA molecule.

In addition, the expression vector containing the chimeric DNA molecule may include drug selection markers. Such markers aid in cloning and in the selection or identification of vectors containing chimeric DNA molecules. For example, genes that confer resistance to neomycin, puromycin, hygromycin, dihydrofolate reductase (DHFR), guanine phosphoribosyl transferase (GPT), zeocin, and histidinol are useful selectable markers. Alternatively, enzymes such as herpes simplex virus thymidine kinase (tk) or chloramphenicol acetyltransferase (CAT) may be employed. Immunologic markers also can be employed. Any known selectable marker may be employed so long as it is capable of being expressed simultaneously with the nucleic acid encoding a gene product. Further examples of selectable markers are well known to one of skill in the art and include reporters such as enhanced green fluorescent protein (EGFP), beta-galactosidase (β-gal) or chloramphenicol acetyltransferase (CAT).

Consequently, mammalian and typically human cells, as well as bacterial, yeast, fungi, insect, nematode and plant cells can used in the present invention as host cells and may be transformed by the expression vector as defined herein. In some cellular hosts, such as mammalian cells, the cell containing the chimeric DNA molecule may be "isolated" in that it is removed from its original environment (e.g., the natural environment if it is naturally occurring). In other embodiments, such as plants, the cells do not have to be isolated in that the whole plant may be used rather than a culture of plant cells or parts.

Examples of suitable cells include, but are not limited to, VERO cells, HELA cells such as ATCC No. CCL2, CHO cell lines such as ATCC No. CCL61, COS cells such as COS-7 cells and ATCC No. CRL 1650 cells, W138, BHK, HepG2, 3T3 such as ATCC No. CRL6361, A549, PC12, K562 cells, 293 cells, Sf9 cells such as ATCC No. CRL1711 and Cv1 cells such as ATCC No. CCL70.

Other suitable cells that can be used in the present invention include, but are not limited to, prokaryotic host cells strains such as *Escherichia coli*, (e.g., strain DH5-α), *Bacillus sub-*

*tilis, Salmonella typhimurium*, or strains of the genera of *Pseudomonas, Streptomyces* and *Staphylococcus*. Further suitable cells that can be used in the present invention include yeast cells such as those of *Saccharomyces* such as *Saccharomyces cerevisiae.*

Host cells containing the polynucleotides of interest can be cultured in conventional nutrient media (e.g., Ham's nutrient mixture) modified as appropriate for activating promoters, selecting transformants or amplifying genes. The culture conditions, such as temperature, pH and the like, are those previously used with the host cell selected for expression, and will be apparent to the ordinarily skilled artisan. Cells are typically harvested by centrifugation, disrupted by physical or chemical means, and the resulting crude extract retained for further purification. Microbial cells employed in expression of proteins can be disrupted by any convenient method, including freeze-thaw cycling, sonication, mechanical disruption, or use of cell lysing agents, all of which are well known to those skilled in the art. Embodiments that involve cell lysis may entail use of a buffer that contains protease inhibitors that limit degradation after expression of the chimeric DNA molecule. Suitable protease inhibitors include leupeptin, pepstatin or aprotinin. The supernatant then may be precipitated in successively increasing concentrations of saturated ammonium sulfate.

The protein conjugates product may be purified via one or more techniques. Typically, purification entails combinations of individual procedures such as gel filtration, affinity purification, salt fractionation, ion exchange chromatography, size exclusion chromatography, hydroxylapatite adsorption chromatography, hydrophobic interaction chromatography and gel electrophoresis. Protein refolding steps can be used, as necessary, in completing configuration of the protein conjugate. High performance liquid chromatography (HPLC) is often useful for final purification steps. See, in general, Robert K. Scopes, Protein Purification: Principles and Practice (Charles R. Castor, ed., Springer-Verlag 1994) and Joseph Sambrook, Molecular Cloning: A Laboratory Manual, $2^{nd}$ edition (Cold Spring Harbor Laboratory Press 1989). Examples of multi-step purification separations are also described in Baron, et al., Crit. Rev. Biotechnol. 10:179-90 (1990) and Below, et al., J. Chromatogr. A. 679:67-83 (1994).

The conjugates are tested prior to use to determine whether they exhibit modified plasma half-life compared to the unconjugated protein. For example, in experiments conducted with G-CSF and various amino acid extensions such as (NNT), Applicants found that the half-life was increased in one case, and in other cases, was decreased. The tests may be conducted in accordance with standard techniques in pharmacokinetics, as shown in example 3. This procedure entails administration of a predetermined dose of the conjugate to an animal, preferably a laboratory animal such as a rodent, e.g., mouse, collect plasma from the animal at predetermined intervals, and analyze the plasma e.g., via Enzyme-Linked Immunosorbent Assay ("ELISA"), to determine concentration of the conjugate, until concentration was no longer measurable. The half-life may be calculated via a non-compartmental pharmacokinetic analysis (e.g., using WINNonLin software version 4.1). In addition to the last time at which the conjugate concentration was measurable ($t_f$), the analysis includes observation or calculation of the following main parameters: $\lambda_Z$, apparent terminal rate constant associated to the apparent terminal phase, estimated by linear regression analysis of the logarithm of the plasma concentrations versus time in the monoexponential terminal part of the curve, $t_{1/2,z}$, apparent terminal half-life, calculated according to the following equation: $t_{1/2,z}=\ln(2)/\lambda_z$; AUC, area under the plasma concentration-time curve from time zero to infinity; AUC/D, area under the plasma concentration-time curve per unit of dose; MRT, mean residence time calculated as the ratio between the area under the first moment curve, AUMC, and AUC; CL, systemic clearance, calculated as CL=D/AUC; and $V_{ss}$, steady state volume of distribution, calculated as $V_{ss}$=CL*MRT.

A further aspect of the present invention relates to a composition comprising the protein conjugate and a carrier. Broadly, the carrier may be a culture medium or a matrix (e.g., a purification matrix). In some embodiments, the carrier is a pharmaceutically acceptable carrier, in which case the composition is useful for preventing or treating disorders and/or diseases in a human or animal, most preferably in a mammal, or for diagnostic purposes. As an active ingredient of the composition, the protein conjugate is preferably in a soluble form.

Generally, the composition comprises a pharmaceutically effective amount of the protein conjugate which achieves the desired effect e.g., therapeutic or diagnostic. Pharmaceutically effective amounts can be estimated from cell culture assays. For example, a dose can be formulated in animal models to achieve a circulating concentration range that includes or encompasses a concentration point or range having the desired effect in an in vitro system. See, e.g., Molineux, et al., Exp. Hematol. 27:1724-34 (1999). This information can thus be used to accurately determine the doses in other mammals, including humans and animals. In general, dosage amounts range from about 1 ng/kg to about 10 mg/kg based on weight of the subject.

Toxicity and therapeutic efficacy of such compounds can be determined by standard pharmaceutical procedures in cell cultures or in experimental animals. See, e.g., Molineux, et al., Exp. Hematol. 27:1724-34 (1999). For example, the LD50 (the dose lethal to 50% of the population) as well as the ED50 (the dose therapeutically effective in 50% of the population) can be determined using methods known in the art. The dose ratio between toxic and therapeutic effects is the therapeutic index that can be expressed as the ratio between LD50 and ED50 compounds that exhibit high therapeutic indices.

The data obtained from the cell culture and animal studies can be used in formulating a range of dosage of such compounds which lies preferably within a range of circulating concentrations that include the ED50 with little or no toxicity.

The compositions can be administered via any suitable route such as locally, orally, systemically, intravenously, intramuscularly, mucosally, transdermally (e.g., via a patch). They may be encapsulated in liposomes, microparticles, microcapsules, nanoparticles and the like. Techniques for formulating and administering biologically active polypeptides are also disclosed in Remington: The Science and Practice of Pharmacy (Alfonso R. Gennaro, et al., eds. Philadelphia College of Pharmacy and Science 2000).

In order to fully illustrate the present invention and advantages thereof, the following specific examples are given, it being understood that the same are intended only as illustrative and in no way limitative.

Example 1

Cloning of Chimeric DNA Molecule

For ease of downstream protein purification, it was decided that the G-CSF-polymer proteins were secreted into the cell culture medium. Prior experience using bacterial (ST2) secretion signals with various cytokine-polymer constructs showed low secretion efficiency in both prokaryotic and eukaryotic systems. However, the use of the *Schizosaccharomycen pombe* secretion signal sequence of the pho1+ acid phosphatase (PHO) for the secretion of heterologous proteins (GFP and HPV 16 E7) into a medium was known. Therefore, this secretion signal was tested with the G-CSF-polymer constructs described below in a CHO cell expression system. Also described below are the vectors that were synthesized for the production of G-CSF-polymer constructs and expression of G-CSF-polymers.

1.A. Production of PHO x pBSK Construct

PHO x pBSK Construct

The first construct synthesized was simply the PHO leader sequence cloned into the bacterial cloning vector pBSK. The amino acid sequence of the PHO secretion signal is listed below.

```
                                   (SEQ ID NO: 154)
        M F L Q N L F L G F L A V V C A N A
```

The PHO secretion signal was synthesized by fusing two sets of complementary DNA oligonucleotides together and cloning them into pBSK. The most important consideration that went into the design of the oligonucleotides was that the fusion of the leader sequence to the N-terminus of the G-CSF-polymer be direct, without any intervening sequence. This ensured that the entire secretion signal was clipped from the molecule during processing, resulting in a secreted form of G-CSF with no amino-terminal modification when compared to naturally occurring and clinically available versions of G-CSF. By preparing the constructs in this manner, not only could direct comparisons to G-CSF and PEG-G-CSF be made, but this also limited any potential immunogenicity by introducing additional amino acids into the recombinant G-CSF protein. By incorporating restriction sites into the oligonucleotides for cloning the PHO leader into pBSK, as well as the subsequent cloning G-CSF into PHO x pBSK, these requirements were satisfied. The oligonucleotides that were used are listed below.

```
oNDEPHO-1F:
                                   (SEQ ID NO: 155)
5'-GGCCGCCATATGTTCTTGCAAAATTTATTCCTTGGCT-3'

oNDEPHO-1R:
                                   (SEQ ID NO: 156)
5'-CCAAAAAGCCAAGGAATAAATTTTGCAAGAACATATGGC-3'

oNDEPHO-2F:
                                   (SEQ ID NO: 157)
5'-TTTTGGCCGTTGTTTGCGCAAACGCGTCCCGCAGGTG-3'

oNDEPHO-2R:
                                   (SEQ ID NO: 158)
5'-GATCCACCTGCGGGACGCGTTTGCGCAAACAACGG-3'
```

A diagram of the PHO x pBSK vector is shown in FIG. 1. The PHO leader (PhoA) was cloned into pBSK using NotI and BamHI. The sequence for mature G-CSF was cloned into this construct utilizing the BspMI and BamHI sites. This vector confers ampicillin resistance (bla) when grown in bacteria.

Method of Construction

Complementary pairs of oligonucleotides (oNDEPHO-1F and oNDEPHO-1R) and (oNDEPHO-2F and oNDEPHO-2R) were phosphorylated using T4 Polynucleotide Kinase (PNK). The T4 PNK was heat-inactivated and the oligonucleotide pairs were allowed to slowly anneal on ice. The reactions were diluted in TE and used in a ligation with pBSK previously digested using NotI and BamHI. Ligation products were electroporated into Top 10 competent cells and grown on LB-ampicillin plates. Minipreps were performed on ampicillin resistant colonies to isolate DNA and diagnostic digests identified putative clones. Sequence analysis determined which of the putative clones were correct.

1.B. Production of PHO-G-CSF-NN x pBSK Construct

PHO-G-CSF-NN x pBSK Construct

This construct resulted from the cloning of PCR amplified material corresponding to the coding sequence of mature G-CSF into the PHO x pBSK vector using BspMI and BamHI. As stated previously, the oligonucleotides used for this purpose were designed to ensure that the junction between PHO and G-CSF had no intervening sequence by utilizing the restriction enzyme BspMI. Furthermore, the C-terminus of G-CSF had a direct fusion of two asparagine residues (NN) and restriction sites for the enzymes BbsI and BamHI. BbsI was subsequently utilized to directly add the NNT polymer to the C-terminus of G-CSF, while BamHI was used to clone GCSF-NN into the vector.

The oligonucleotides that were synthesized to amplify G-CSF are as follows:

```
oBspMIGCSF:
                                   (SEQ ID NO: 159)
5'-CGATCGACCTGCAAGTCGCGACTCCGCTGGGTCCAGCTA-3'

oGCSFBbsBam:
                                   (SEQ ID NO: 160)
5'-CGGGATCCGAAGACGTGTTGTTAGGCTGGGCAAGGTGGC-3' 3'
```

Figure 2:
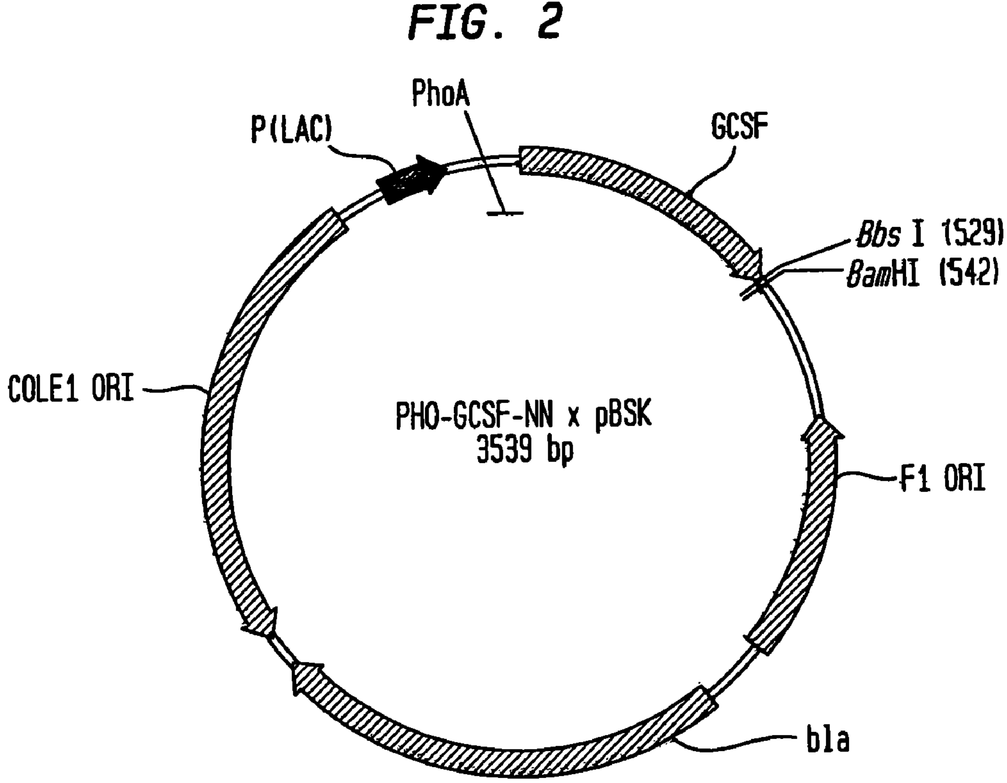
FIG. 2 is a schematic representation of the PHO-G-CSF-NN x pBSK vector.

A diagram of the PHO-G-CSF-NN x pBSK vector is shown in FIG. 2. The sequence for mature G-CSF-NN was cloned into PHO x pBSK using BspMI (destroyed) and BamHI. The subsequent addition of an NNT polymer utilized the BbsI and BamHI sites indicated on the plasmid map. This vector confers ampicillin resistance (bla) when grown in bacteria.

Method of Construction

G-CSF was amplified by PCR using oBspMIGCSF and oGCSFBbsBam oligonucleotides. The ≈520 bp band corresponding to mature G-CSF was excised from an agarose gel and purified. The purified fragment was digested with BspMI and BamHI, purified and ligated into PHO x pBSK cut with the same enzymes. The ligation products were electroporated into Top10 competent cells and grown on LB-ampicillin plates. Minipreps were performed on ampicillin resistant colonies to isolate DNA and diagnostic digests identified putative clones. Sequence analysis determined which of the putative clones were correct.

1.C. Production of PHO-G-CSF-NNT65 x pBSK Construct (NNT65 Disclosed as SEQ ID NO: 1)

PHO-G-CSF-NNT65 x pBSK Construct (NNT65 Disclosed as SEQ ID NO: 1)

The amino acid composition of this polymer encodes for the consensus mammalian N-linked glycosylation site, N-X-(S/T). Therefore, the polymer may be glycosylated on the threonine residues of the polymer extension when this construct is expressed in CHO cells. The expectation was that the polymeric increase in translated product size and posttranslational modification would modulate the pK parameters of G-CSF, conferring upon the protein-enhanced half-life in serum without decreasing its biological activity.

The construction of this polymer was achieved using an oligonucleotide ligation/multimerization scheme. By cutting the PHO-G-CSF-NN x pBSK construct with BbsI, a four base underhang (GTTG) was created in the two asparagines residues added to the C-terminus of G-CSF. By designing complementary sets of oligonucleotides that code for repeating NNT triplets as well as anneal to the GTTG underhang, it was possible to multimerize the oligonucleotides that code for 9 amino acids into longer chains. Short adaptors containing a stop codon, a BbsI site for future extension of the polymer and a BamHI site were added in low ratios to terminate the multimerization and allow for cloning of the BbsI-BamHI polymer fragment into PHO-G-CSF-NN x pBSK.

The oligonucleotides used to synthesize the NNT65 polymer (NNT65 disclosed as SEQ ID NO: 1) are listed below:

Polymer Backbone Oligonucleotides

```
                                   (SEQ ID NO: 161)
o3NNTF:     5'-CAACACCAACAATACCAACAATACAAA-3'

                                   (SEQ ID NO: 162)
o3NNTR:     5'-GTTGTTTGTATTGTTGGTATTGTTGGT-3'
```

Adaptor Oligonucleotides

```
oDent3F:    5'-CAACTAGTCTTCG-3'   (SEQ ID NO: 163)

oDent3R:    5'-GATCCGAAGACTA-3'   (SEQ ID NO: 164)
```

The following sequence (NTNNTNNTN) (SEQ ID NO: 165) was the repeating unit of the NNT polymer that was produced using the polymer backbone oligonucleotides of o3NNTF and o3NNTR, which show a CAAC overhang and GTTG underhang respectively that were used to multimerize the polymer.

```
                                      (SEQ ID NO: 165)
       N T N N T N N T N

                                      (SEQ ID NO: 166)
5'-C AAC ACC AAC AAT ACC AAC AAT ACA AA-3'  (o3NNTF)

                                      (SEQ ID NO: 167)
3'-TGG TTG TTA TGG TTG TTA TGT TTG TTG-5'  (o3NNTR)
```

The following is the terminating adaptor molecule that completed the polymer and included a stop codon, BbsI site for future extension of the polymer and a BamHI site that is necessary for cloning.

Terminating Adaptor Molecule

```
     N    *
5'-C AAC TAG TCT TCG-3'  (oDent3F) (SEQ ID NO: 168)

3'-ATC AGA AGC CTA G-5'  (oDent3R) (SEQ ID NO: 169)
          BbsI    BamHI
```

BbsI BamHI

Figure 3:
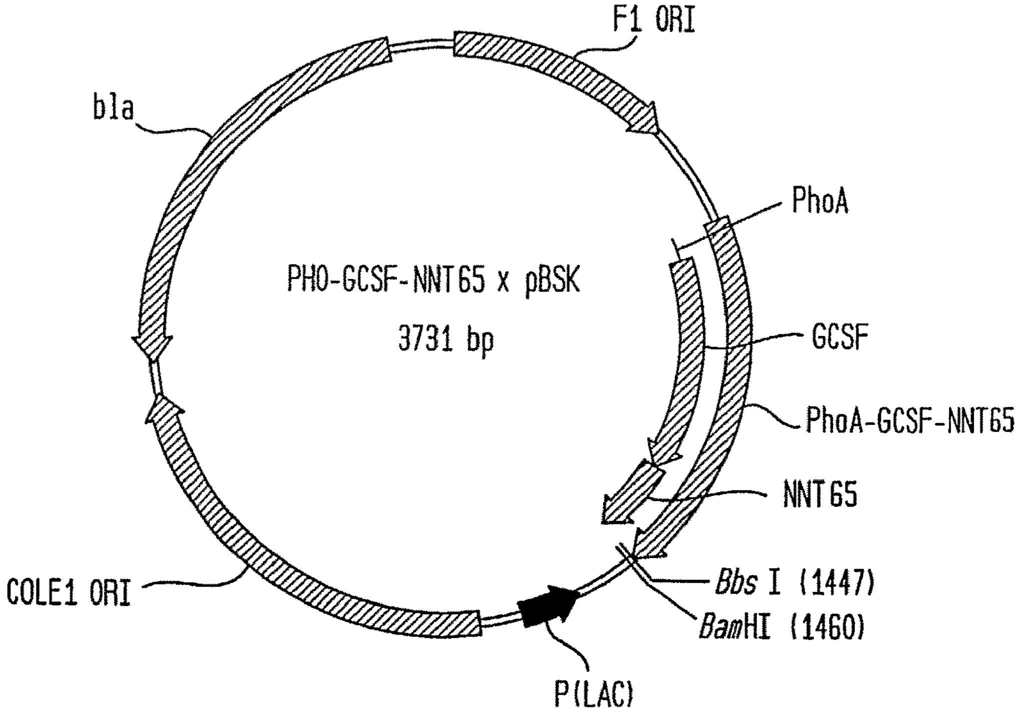
FIG. 3 is a schematic representation of the PHO-G-CSF-NNT65 x pBSK vector (NNT65 disclosed as SEQ ID NO: 1).

A diagram of the PHO-G-CSF-NNT65 x pBSK vector (NNT65 disclosed as SEQ ID NO: 1) is shown in FIG. 3. The addition of NNT65 polymer (NNT65 disclosed as SEQ ID NO: 1) utilized the BbsI site (destroyed) that was located at the C-terminus of G-CSF and BamHI. As shown in FIG. 3, the BbsI site was regenerated at the end of the NNT65 polymer (NNT65 disclosed as SEQ ID NO: 1) for future extension of length. This vector confers ampicillin resistance (bla) when grown in bacteria.

Method of Construction

Complementary pairs of polymer backbone oligonucleotides (o3NNTF and o3NNTR) and adaptor oligonucleotides (oDent3F and oDent3R) were phosphorylated using T4 PNK. The T4 PNK was heat-inactivated and the oligonucleotide pairs were allowed to slowly anneal on ice. Polymer multimerization was performed by mixing polymer and adaptor duplexes at 20:1 and 40:1 ratios with T4 Ligase. The T4 ligase was heat-inactivated and the entire ligation reactions were digested with BamHI overnight. Both reactions were precipitated and ran on an acrylamide gel. Material between 250 bp-800 bp was excised and gel purified.

This material was used in a ligation with PHO-G-CSF-NN x pBSK that had been digested with BbsI and BamHI. Chemically competent Stb12 cells were transformed with the ligation products and grown on LB-ampicillin plates. Minipreps were performed to isolate DNA and diagnostic digests identified putative clones. Sequence analysis determined which of the putative clones were correct.

The longest clone isolated from this strategy was PHO-G-CSF-NNT65 x pBSK (NNT65 disclosed as SEQ ID NO: 1).

1.D. Production of PHO-G-CSF-NNT155 x pBSK Construct (NNT155 Disclosed as SEQ ID NO: 2)

PHO-G-CSF-NNT155 x pBSK Construct (NNT155 Disclosed as SEQ ID NO: 2)

The construction of this clone required the addition of additional NNT residues to the PHO-G-CSF-NNT65 x pBSK construct (NNT65 disclosed as SEQ ID NO: 1) using the same oligomerization scheme. The nucleotide composition of the oligonucleotides used in this extension was altered to identify the junction between the original polymer and the extension. These alterations maintained the original NNT composition of the polymer and utilized the same GTTG underhang and CAAC overhang strategy. By digesting PHO-GCSF-NNT65 (NNT65 disclosed as SEQ ID NO: 1) with BbsI and BamHI, it was possible to extend the length of the polymer using the same oligonucleotide multimerization strategy as before.

The oligonucleotides used to extend the NNT65 polymer (NNT65 disclosed as SEQ ID NO: 1) to NNT155 (NNT155 disclosed as SEQ ID NO: 2) are listed below:

Polymer Backbone Oligonucleotides

```
                                      (SEQ ID NO: 170)
o3NNTextF:    5'-CAACACCAATAATACCAACAATACAAA-3'

                                      (SEQ ID NO: 171)
o3NNTextR:    5'-GTTGTTTGTATTGTTGGTATTATTGGT-3'
```

Adaptor Oligonucleotides

```
oDent3F:    5'-CAACTAGTCTTCG-3'   (SEQ ID NO: 172)

oDent3R:    5'-GATCCGAAGACTA-3'   (SEQ ID NO: 173)
```

As with the production of the PHO-G-CSF-NNT65 x pBSK Construct (NNT65 disclosed as SEQ ID NO: 1), NTNNTNNTN (SEQ ID NO: 165) was the repeating unit of the NNT polymer extension that was produced using the polymer backbone oligonucleotides of o3NNTextF and o3NNTextR, in which the CAAC overhang and GTTG underhang were still used to multimerize the polymer and the amino acid composition was unchanged from the original NNT65 polymer (NNT65 disclosed as SEQ ID NO: 1).

```
                                      (SEQ ID NO: 165)
     N T N N T N N T N

                                      (SEQ ID NO: 174)
5'-C AAC ACC AAT AAT ACC AAC AAT       (o3NNTextF)
ACA AA-3'

                                      (SEQ ID NO: 175)
3'-TGG TTA TTA TGG TTG TTA TGT TTG     (o3NNTextR)
TTG-5'
```

The above underlined nucleotides of o3NNTextF and o3NNTextR differed from the nucleotides in the same position in o3NNTF and o3NNTR respectively.

The following is the terminating adaptor molecule that completed the NNT155 polymer (NNT155 disclosed as SEQ ID NO: 2) and included the BamHI site necessary for cloning. oDent3F and oDent3R are the same oligonucleotides that were used for the initial NNT65 polymer (NNT65 disclosed as SEQ ID NO: 1).

Terminating Adaptor Molecule

```
     N *
5'-C AAC TAG TCT TCG-3'   (oDent3F) (SEQ ID NO: 176)

3'-ATC AGA AGC CTA G-5'   (oDent3R) (SEQ ID NO: 177)
           BbsI BamHI
```

Figure 4:
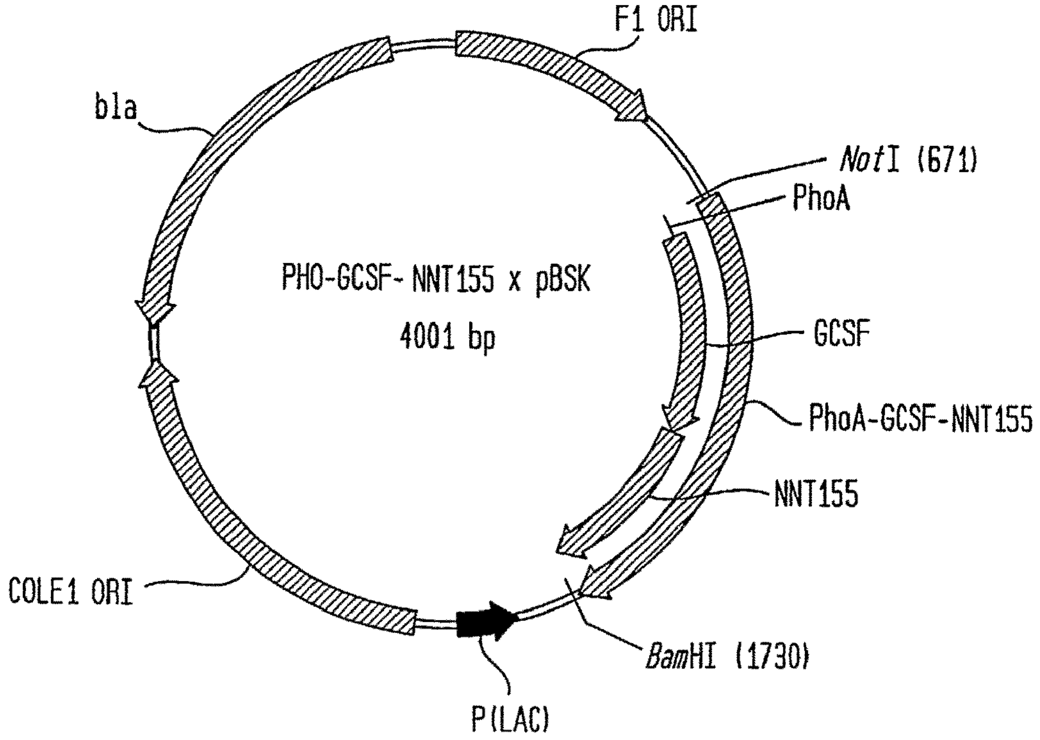
FIG. 4 is a schematic representation of the PHO-G-CSF-NNT155 x pBSK vector (NNT155 disclosed as SEQ ID NO: 2).

A diagram of the PHO-G-CSF-NNT155 x pBSK vector (NNT155 disclosed as SEQ ID NO: 2) is shown in FIG. 4. The extension of the NNT65 polymer (NNT65 disclosed as SEQ ID NO: 1) by 90AA utilized the BbsI site (destroyed) that was located at the C-terminus of PHO-G-CSF-NNT65 x pBSK (NNT65 disclosed as SEQ ID NO: 1) and BamHI. It was noted that the BbsI site was regenerated at the end of the NNT155 (NNT155 disclosed as SEQ ID NO: 2) polymer for future extension of length. This vector confers ampicillin resistance (bla) when grown in bacteria.

Method of Construction

Complementary pairs of polymer backbone oligonucleotides o3NNTextF and o3NNTextR, and adaptor oligonucleotides oDent3F and oDent3R were phosphorylated using T4 PNK. The T4 PNK was heat-inactivated and the oligonucleotide pairs were allowed to slowly anneal on ice. Polymer oligimerization was performed by mixing polymer and adaptor duplexes at 20:1 and 40:1 ratios with T4 Ligase. The T4 Ligase was heat-inactivated and the entire ligation reactions were digested with BamHI overnight. Both reactions were precipitated and ran on an acrylamide gel. Material between 250 bp to 800 bp was excised and gel purified. This material ligated into PHO-G-CSF-NNT65 x pBSK (NNT65 disclosed as SEQ ID NO: 1) digested with BbsI and BamHI. Chemically competent Stb12 cells were transformed with the ligation products and grown on LB-ampicillin plates. Minipreps were performed to isolate DNA and diagnostic digests identified putative clones. Sequence analysis determined which of the putative clones were correct.

The longest clone isolated from this strategy was PHO-G-CSF-NNT155 x pBSK (NNT155 disclosed as SEQ ID NO: 2).

Example 2

Transformation of Host Cell and Expression of Chimeric DNA Molecule

2.A. Production of PHO-G-CSF-NNT155 x pCE2 Construct (NNT155 Disclosed as SEQ ID NO: 2)

Preparation of Vector pCE2

The plasmid pCE2 was derived from the plasmid pREP7b, through the following manipulations. First, the 2000 bp EBNA coding region was deleted. Next, pBR322ori was replaced with pKS-ori. Then, the RSV promoter region was replaced by the CMV enhancer and the elongation factor-1a (EF-1a) promoter and intron.

The CMV enhancer was derived from a 380 bp XbaI-SphI fragment produced by the polymerase chain reaction (PCR) from pCEP4 (Invitrogen, San Diego, Calif.) using the following primers:

```
                                    (SEQ ID NO: 178)
5'-GGCTCTAGAT ATTAATAGTA ATCAATTAC-3';
and

                                    (SEQ ID NO: 179)
5'-CCTCACGCAT GCACCATGGT AATAGC-3'.
```

The EF-1a promoter and intron (Uetsuki, et al., J. Biol. Chem. 264:5791-5798 (1989)) were derived from a 1200 bp SphI-Asp718I fragment produced by PCR from human genomic DNA using the following primers:

```
                                    (SEQ ID NO: 180)
5'-GGTGCATGCG TGAGGCTCCG GTGC-3';
and

                                    (SEQ ID NO: 181)
5'-GTAGTTTTCACGGTACCTGAAATGGAAG-3'.
```

The two fragments were ligated into a XbaI/Asp718I digested vector derived from pREP7b to generate pCE2.

PHO-G-CSF-NNT155 x pCE2 Construct (NNT155 Disclosed as SEQ ID NO: 2)

In order to express PHO-G-CSF-NNT155 (NNT155 disclosed as SEQ ID NO: 2) in mammalian cells, it was necessary to move the construct into the vector pCE2. This vector contained the minimal promoter and the first intron for the human elongation factor-1-α flanked by the immediate-early CMV enhancer. The vector also contained the hygromycin B resistance marker for mammalian selection.

Figure 5:
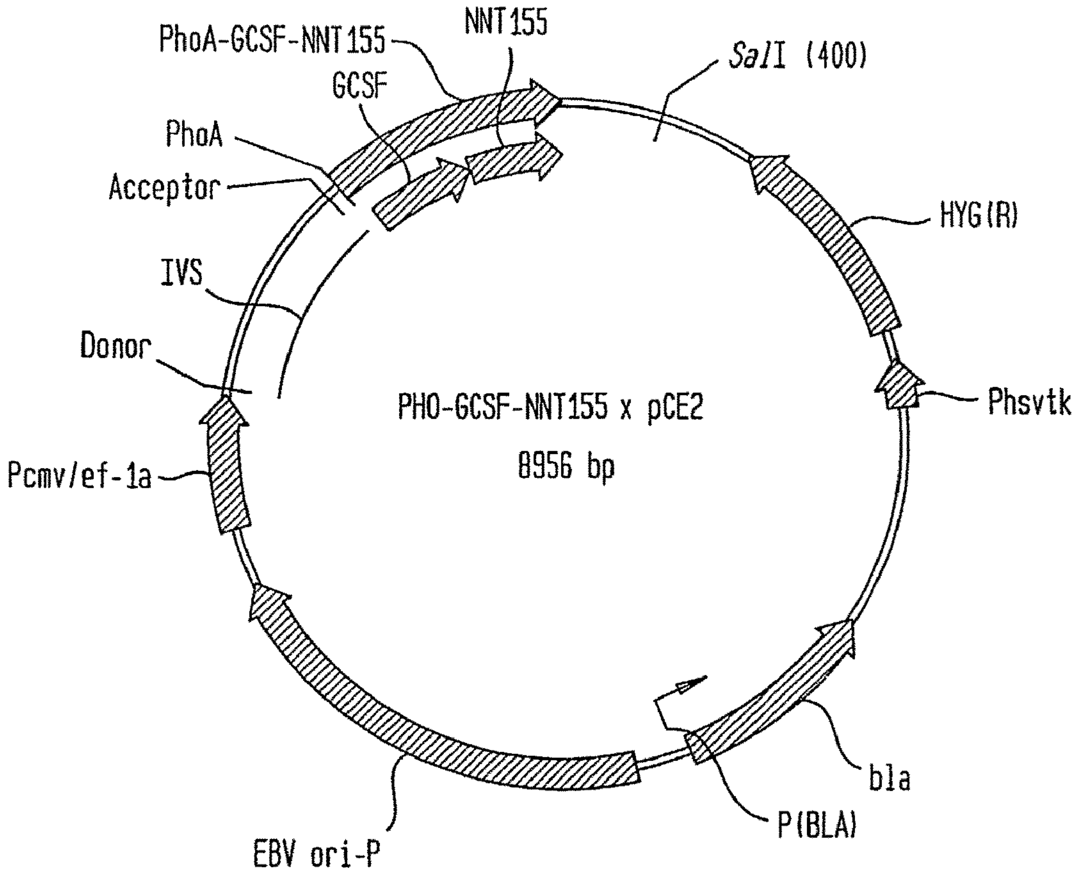
FIG. 5 is a schematic representation of the PHO-G-CSF-NNT155 x pCE2 vector (NNT155 disclosed as SEQ ID NO: 2).

A diagram of the PHO-G-CSF-NNT155 x pCE2 vector (NNT155 disclosed as SEQ ID NO: 2) is shown in FIG. 5. The promoter that drives expression in CHO cells is Pcmv/ef-1a. The vector was linearized for electroporation into CHO cells using SalI. This vector confers resistance to hygromycin B in mammalian cells and ampicillin resistance (bla) when grown in bacteria.

Method of Construction

This construct was produced by isolating and gel purifying the 1100 bp NotI-BamHI fragment from PHO-G-CSF-NNT155 x pBSK (NNT155 disclosed as SEQ ID NO: 2). This material was ligated into pCE2 that had been digested with NotI and BamHI. Chemically competent Stb12 cells were transformed with the ligation products and grown on LB-ampicillin plates. Minipreps were performed to isolate DNA and diagnostic digests identified putative clones. Large-scale maxipreps were performed to isolate microgram quantities of the plasmid for CHO cell transformation.

2.B. Production of Transfectant Cell Lines

In order to produce the polymers described above, mammalian cells were used as host cells for expression. In this instance, Chinese hamster ovary (CHO) cell lines were chosen. CHO cells are widely used in the pharmaceutical industry to express recombinant protein therapeutics including G-CSF and EPO. As described below, expression cultures of G-CSF-polymer constructs in CHO cells were established.

Establishment of Adherent Cultures

The PHO-G-CSF-NNT155 x pCE2 vector (NNT155 disclosed as SEQ ID NO: 2) was linearized using the enzyme SalI. The digest was precipitated and re-suspended in 50 μL of TE. One (1) μg of this plasmid was used in an electroporation along with $5\times10^6$ CHO cells. Adherent CHO cells were grown in Ham's Nutrient Mixture F-12 (F-12 Ham's media) containing 10% FBS. The cells were allowed to recover overnight, and the next day media containing 700 μg/mL of hygromycin B was added to begin selection of resistant cells. The media was changed every 2-3 days as needed over the course of 2-3 weeks. Bulk pools of resistant cells were isolated and passaged two additional times in the presence of hygromycin B.

Figure 6:
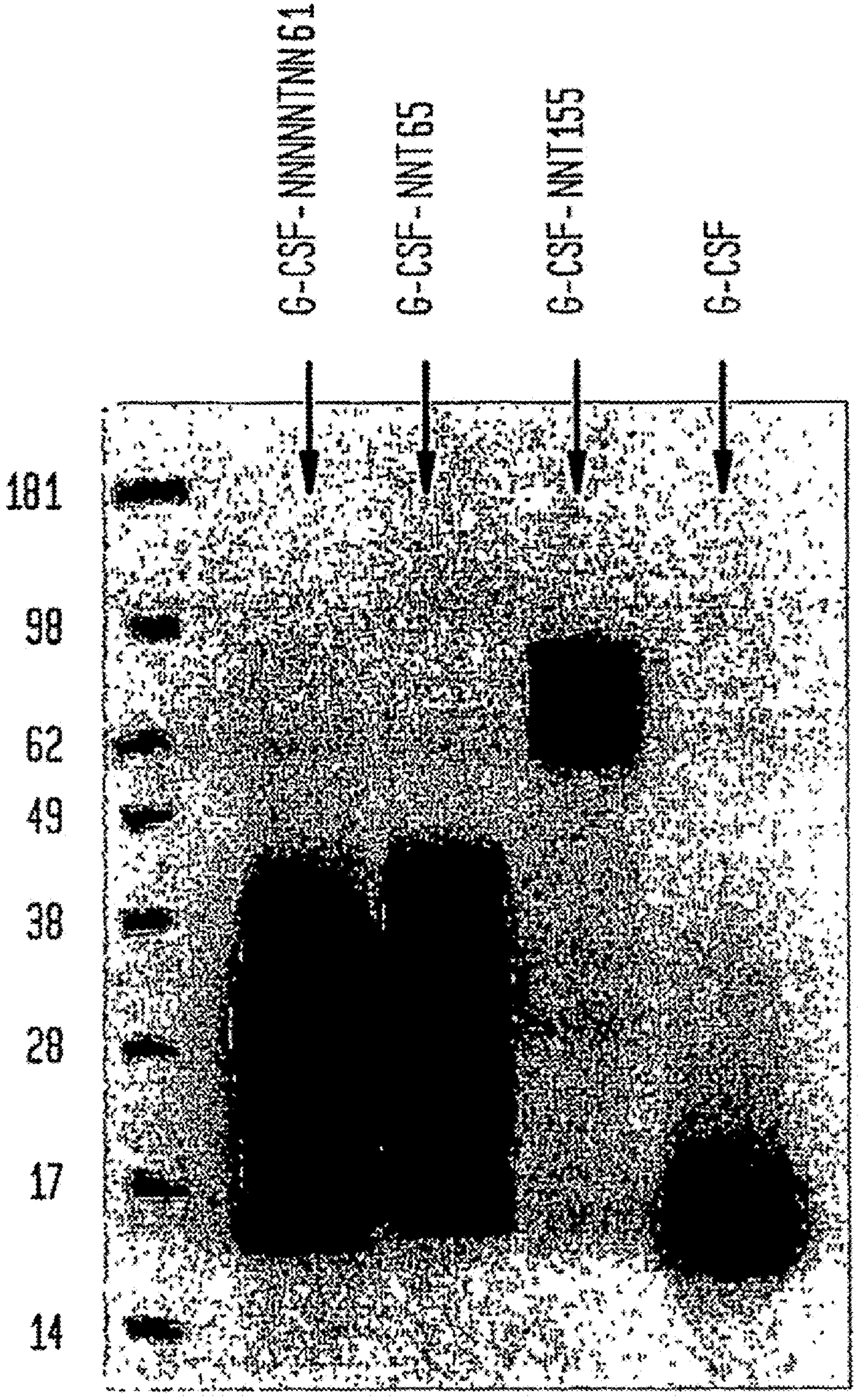
FIG. 6 is a Western blot of several different G-CSF-polypeptide conjugates and unconjugated G-CSF, NNT65, NNT155 and NNNNNTNN61 disclosed as SEQ ID NOS: 1-3, respectively.
Figure 7:
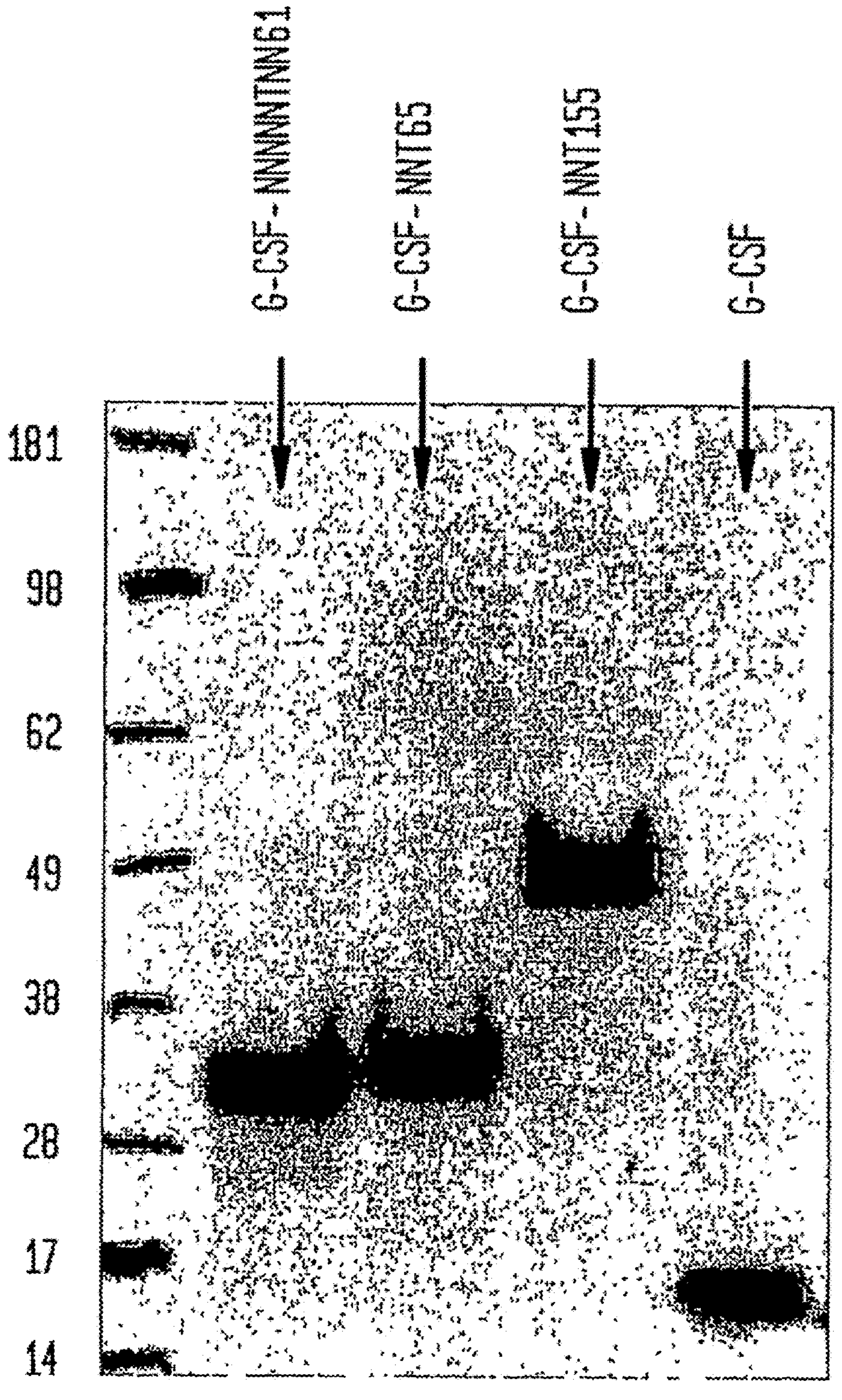
FIG. 7 is a Western blot of several different G-CSF-polypeptide conjugates and unconjugated G-CSF that were treated with PNGase F prior to electrophoresis. NNT65, NNT155 and NNNNNTNN61 disclosed as SEQ ID NOS: 1-3, respectively.

To test these cells for the secretion of PHO-G-CSF-NNT155 (NNT155 disclosed as SEQ ID NO: 2) into the media, the cells were grown in Ham's media containing low serum media (0.5%) for 3-5 days. The media was isolated and used in Western blots that were probed using a polyclonal antibody against G-CSF. The blots are reproduced in FIGS. 6 and 7. The difference between the blots is that the samples in FIG. 7 were additionally subjected to Peptide:N Glycosidase F (PNGase F) treatment. As shown in FIG. 6, the blots showed immunoreactive material migrating at apparent molecular weight ≈95 kDa. As shown in FIG. 7, digestion of these same samples with PNGase F, a glycosidase that removes N-linked glycosylation chains, reduced the immunoreactive material to apparent molecular weight ≈49 kDa. This corresponded approximately to the theoretical size of unmodified G-CSF-NNT155 protein (NNT155 disclosed as SEQ ID NO: 2). Native G-CSF migrates electrophoretically at ≈18 kDa; the addition of the NNT polymer to the C-terminus adds substantial mass to the recombinant, polymeric molecule. The expression also appeared quite stable; no appreciable proteolytic degradation was observed for the unpurified protein present in conditioned medium. Further, as shown in FIG. 7, the decrease in size of the constructs after PNGase F treatment suggested the recombinant protein constructs were subject to a substantial amount of glycosylation.

Establishment of Suspension Cultures

To facilitate purification of G-CSF-NNT155 (NNT155 disclosed as SEQ ID NO: 2) found in the conditioned media of established CHO cultures, cells were grown in a chemically defined, low protein, serum-free media (PROCHO4-CDM, Cambrex). In the process of adapting the cells to this media, the cells adapted from adherent to suspension growth.

Cells were grown in F-12 Ham's+10% FBS to near confluency in T-185 flasks, trypsinized and suspended in PROCHO4-CDM media. 107 cells were added to 50 mL of PROCHO4-CDM and incubated in T-185 flasks. After 4-5 passages, approximately 90% of the cells were no longer adherent and grew as a mixture of single cell and aggregated cell clumps. For conditioned media collections, typically 60 mL of fresh PROCHO4-CDM media was incubated with 7-8 mL of a high cell density culture for 5-6 days. Cells were removed from the media by centrifugation and the media was subsequently clarified using a 0.2 micron filter. The media was quantitated for yield of G-CSF-NNT155 (NNT155 disclosed as SEQ ID NO: 2) by Western blot (typically 100-200 μg/L) and stored until needed.

2.C. Expression of G-CSF-NNT Constructs in PROCHO4-CDM

Figure 8:
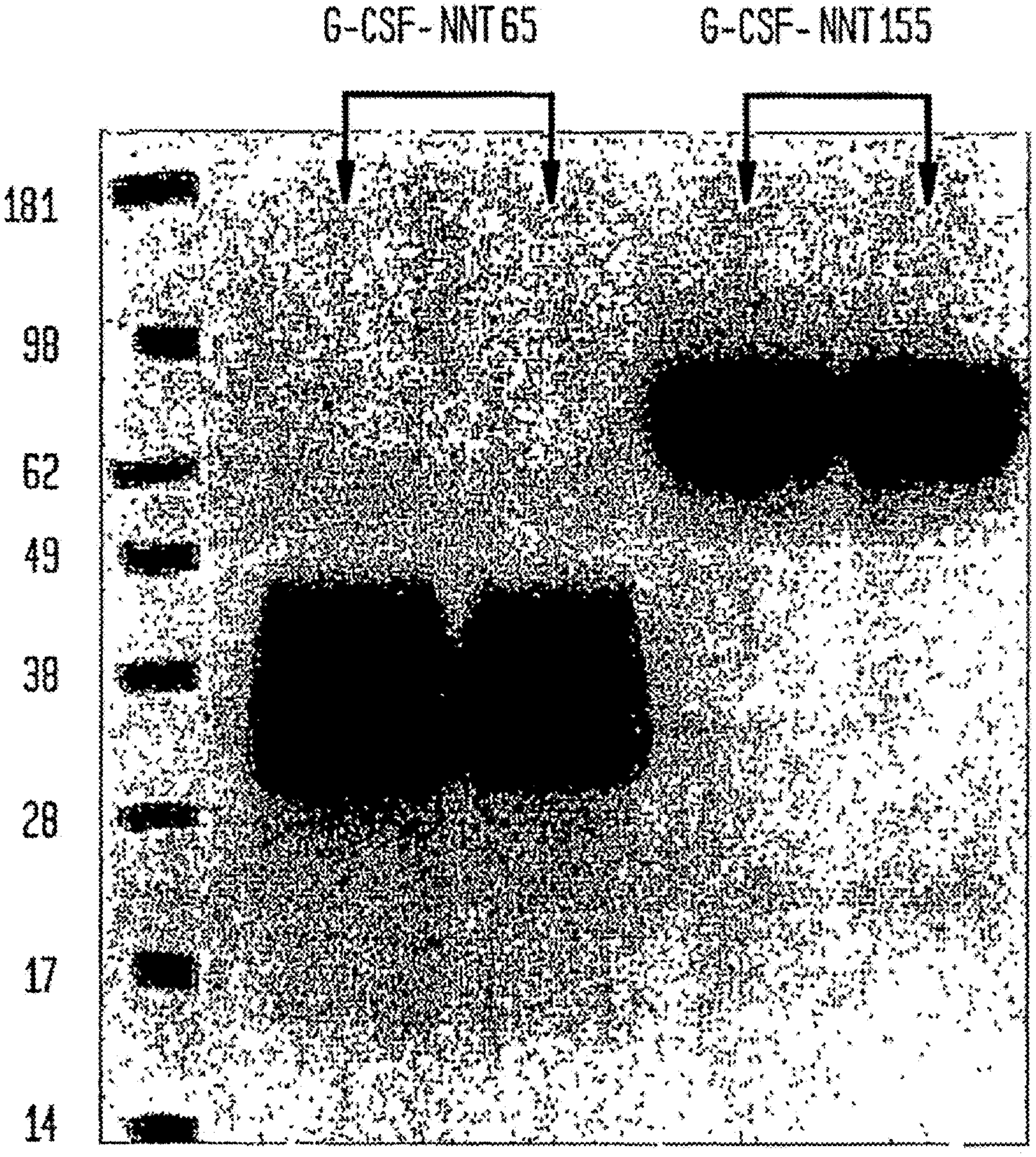
FIG. 8 is a Western blot of the G-CSF-NNT155 (NNT155 disclosed as SEQ ID NO: 2) and G-CSF-NNT65 (NNT65 disclosed as SEQ ID NO: 1) constructs (in duplicate) that were expressed in CHOK1 cells grown in PROCHO4-CDM media.

Samples were conditioned media from the foregoing bulk CHO cell lines grown for 6 days in PROCHO4-CDM. Western blots were probed using polyclonal antibody against G-CSF. As shown in FIG. 8, the size of both constructs were the same as was seen in Ham's media (as described above) and there was no degradation observed in the G-CSF-NNT155 (NNT155 disclosed as SEQ ID NO: 2) cell lines.

2.D. Optimization of Expression

Various chemical and nutrient additives as well as various environmental parameters were tested in an attempt to determine growth conditions necessary to maximize expression of the desired product. The following approaches resulted in an increase in protein accumulation.

Chemical Additives

Although it was known that not all chemical additives result in an increase in protein production, published literature indicated that the addition of adenosine or AMP to 2.5 mM leads to cell cycle arrest; effectively prolonging cell culture viability with a concomitant increase in protein accumulation. The effect of AMP was tested on CHO-mediated production of G-CSF-NNT155 (NNT155 disclosed as SEQ ID NO: 2) production in ProCHO4 chemically defined medium (CDM). AMP was added at a final concentration of 1 mM in ProCHO4 CDM. No decrease in cell viability compared to control was observed. The addition of AMP resulted in a slight increase in protein production.

Environmental Parameters

Temperature Changes

Reduced incubation temperatures for CHO cultures can lead to markedly enhanced levels of protein production. As was found with other protein production enhancement methods, the observed effect is due to enhanced protein production during cell cycle arrest. The effect of reducing the incubation temperature of the recombinant CHO line from 37° C. to 28° C. was examined. Although cultures maintained at 28° C. remained viable considerably longer than those at 37° C., the lower temperature did not result in higher recombinant protein production.

Adaptation to Suspension Culture

The bulk CHO population was converted to spinner flask culture conditions. Adaptation to suspension culture was mediated by growth in ProCHO4 CDM. Following adaptation, cells were expanded in T-flasks and seeded into spinner flasks containing ProCHO5 CDM at various densities. A marked increase in protein production was observed during adaptation to suspension culture in ProCHO5 CDM, regardless of whether the cells were grown in static or spinner cultures.

Use of Different Cell Lines as Hosts

One approach to optimization of expression may be to use a new cell line for host cells. Accordingly, a new shipment of CHO-K1 from ATCC was obtained. The new population was propagated and banked at an early passage for future use. This defined culture was used to generate stable clonal cell lines expressing the recombinant protein of interest. Briefly, CHO-K1 cells were electroporated with the vector of interest and selected for stable expression of hygromycin. 92 colonies were isolated and evaluated for expression of the recombinant protein of interest. Many of these colonies exhibited expression levels that were markedly higher than that of the original transfected population, described above.

Results

A very slight enhancement of expression was observed when cultures were treated with 1 mM AMP. Reduced culture temperatures increased the longevity of the cultures, but there was no enhancement of protein expression. Adaptation to suspension culture conditions in ProCHO5 CDM dramatically enhanced expression of the recombinant protein. Also, isolated clones from an ATCC-defined CHO-K1 cell line expressed the desired protein at significantly higher levels than the originally isolated population.

Example 3

Pharmacokinetic Evaluation of G-CSF-NNT155 Conjugate (NNT155 Disclosed as SEQ ID NO: 2)

The pharmacokinetic parameters of the G-CSF-NNT155 protein conjugate (NNT155 disclosed as SEQ ID NO: 2) was evaluated. Three other compounds were included as positive controls. The controls were NEULASTA (PEG-G-CSF), NEUPOGEN (rh-G-CSF) and G-CSF compounds. The compounds were tested by single intravenous (i.v.) administration to mice and blood was collected up to 72 hours post-dosing. The plasma was analyzed by the ELISA method.

3.A. Analytical Method

The assay employed the quantitative sandwich enzyme immunoassay technique. A monoclonal antibody specific for G-CSF had been pre-coated onto a microplate. Standards and samples were pipetted into the wells. Any G-CSF present was bound by the immobilized antibody. After washing away any unbound substances, an enzyme-linked polyclonal antibody specific for G-CSF was added to the wells. Following a wash to remove any unbound antibody-enzyme reagent, a substrate solution was added to the wells and color developed in proportion to the amount of G-CSF bound in the initial step. The color development was stopped and the intensity of the color was measured.

Reagents

The following reagents and material were used:

- G-CSF Microplate: 96 well polystyrene microplate (12 strips of 8 wells) coated with a murine monoclonal antibody against G-CSF.
- G-CSF conjugate: 21 mL of polyclonal antibody against G-CSF conjugated to horseradish peroxidase, with preservative.
- G-CSF standard: 2 vials (25 ng/mL) of recombinant human G-CSF in a buffered protein base with preservative, lyophilized.
- Assay Diluent RD1A: 11 mL of a buffered protein base with preservative.
- Calibrator Diluent RD5: 21 mL of a buffered protein base with preservative. For cell culture supernate samples.
- Calibrator Diluent RD6A: 21 mL of animal serum with preservative. For serum/plasma samples.
- Wash Buffer Concentrate: 21 mL of a 25-fold concentrated solution of buffered surfactant with preservative.
- Color Reagent A: 12.5 mL of stabilized hydrogen peroxide.
- Color Reagent B: 12.5 mL of stabilized chromogen (tetramethylbenzidine).
- Stop Solution: 6 mL of 2N sulfuric acid.
- Plate Covers: 4 adhesive strips.

Reagent Preparation 20 mL of Wash Buffer Concentrate was diluted into deionized or distilled water to prepare 500 mL of Wash Buffer. The G-CSF Standard was reconstituted with 1 mL deionized or distilled water. This reconstitution produced a stock solution of 25000 pg/mL. The G-CSF standard was allowed to sit for a minimum of 15 minutes with gentle agitation prior to making dilutions. Nine hundred (900) μL of Calibrator Diluent RD6A was pipetted into a 2500 pg/mL tube. 600 μL of the same diluent was pipetted into the remaining 4 tubes. The stock solution was used to produce a dilution series: 25000 pg/mL (1:10) →2500 pg/mL and 25000 pg/mL (1:3) →833.3 pg/mL (1:3) →277.8 pg/mL (1:3) →92.6 pg/mL (1:3) →30.9 pg/mL. Each tube was mixed thoroughly before the next transfer. The 2500 pg/mL standard served as the high standard. The Calibrator Diluent RD6A served as the zero standard (0 pg/mL). The standard curve was performed with 6 point: 2500-833.3-277.8-92.6-30.9-0 pg/mL, double well for each point. For the substrate solution, Color Reagent A and B was mixed together in equal volumes within 15 minutes of use. The reagents were protected from light.

Assay Procedure

All reagents and samples were brought to room temperature before use. All reagents and working standards were prepared. One hundred (100) μL of Assay Diluent RD1A were added to each well, 100 μL of standard and an appropriate volume of sample were also added to each well. The wells were covered with an adhesive strip and incubated for 2 h at room temperature. Each well was aspirated and washed with 400 μL of wash buffer, which was repeated twice for a total of three washes. After the last wash, any remaining wash buffer was removed by aspirating or decanting. The plate was inverted and blotted against clean paper towels. 200 μL of G-CSF conjugate was added to each well. The wells were covered with a new adhesive strip. The wells were incubated for 2 h at room temperature. The aspiration/wash described above was repeated. Two hundred (200) μL of Substrate Solution was added to each well. The wells were incubated for 20 min. at room temperature. The wells were protected from light. Then, 50 μL of stop solution were added to each well. Finally, the optical density of each well within 30 min. was determined using a microplate reader (VersaMax-Molecular Device) set to 450 nm with correction to 570 nm (OD 450 nm-OD 570 nm).

Pharmacokinetic Analysis

A non-compartmental pharmacokinetic analysis (WIN-NonLin software version 4.1) was applied. The following main parameters were observed or calculated for each G-CSF construct: $t_f$, last time at which each compound concentration was measurable; $\lambda_z$, apparent terminal rate constant associated to the apparent terminal phase, estimated by linear regression analysis of the logarithm of the plasma concentrations versus time in the mono-exponential terminal part of the curve; $t_{1/2,z}$, apparent terminal half-life, calculated according to the following equation: $t_{1/2,z}=\ln(2)/\lambda_z$; AUC, area under the plasma concentration-time curve from time zero to infinity; AUC/D, area under the plasma concentration-time curve per unit of dose; MRT, mean residence time calculated as the ratio between the area under the first moment curve, AUMC, and AUC; CL, systemic clearance, calculated as CL=D/AUC; and $V_{ss}$, steady state volume of distribution, calculated as $V_{ss}$=CL*MRT.

Results

As shown in Table 9, pharmacokinetic studies in mice showed that G-CSF-NNT155 (NNT155 disclosed as SEQ ID NO: 2) possessed a longer half-life (6.2 h) than either the G-CSF Control (1.53 h), NEUPOGEN compound (1.13 h) or the NEULASTA compound (3.04 h). G-CSF-NNT155's (NNT155 disclosed as SEQ ID NO: 2) longer half-life corresponded to a more sustained duration of effect compared to all three controls. A corresponding substantial decrease of systemic clearance was observed for G-CSF-NNT155 (NNT155 disclosed as SEQ ID NO: 2), accounting for the 9.5 mL/h/kg systemic clearance. Other conjugates containing amino acid extensions disclosed herein exhibited a decreased half-life relative to control.

Example 4

Bioavailability and Efficacy of G-CSF-$(NNT)_{155}$ NNT155 Conjugate (NNT155 Disclosed as SEQ ID NO: 2)

Neutropenia, a low absolute count of neutrophils, is a serious condition that can impede the fight against infections. To stimulate a peripheral increase in neutrophil counts, granulocyte colony stimulating factor (G-CSF) may be used as a therapy for neutropenia or in combination with other stimulating factors in collection of cells for transplant. The bioavailability of partially purified G-CSF-NNT155 (NNT155 disclosed as SEQ ID NO: 2), PEG-G-CSF (NEULASTA) and rh-G-CSF (NEUPOGEN) was determined and compared via i.v. (intravenous) and s.c. (subcutaneous) administration. The NEUPOGEN compound is a recombinant methionyl human G-CSF. The NEULASTA compound is a covalent conjugate of recombinant methionyl human G-CSF and monomethoxy-polyethylene glycol. As described above, G-CSF-NNT155 (NNT155 disclosed as SEQ ID NO: 2) is an amino acid lengthened and/or glycosylated form of G-CSF.

4.A. Testing For Bioavailability Through ELISA

To evaluate the bioavailability of G-CSF-NNT155 (NNT155 disclosed as SEQ ID NO: 2), an ELISA analysis was performed on plasma samples obtained from mice that were given doses of G-CSF-NNT155 (NNT155 disclosed as SEQ ID NO: 2), PEG-G-CSF and rh-G-CSF through i.v. and s.c. administration.

Test and control articles were as follows: partially purified G-CSF-NNT155 (NNT155 disclosed as SEQ ID NO: 2), PEG-G-CSF (NEULASTA), rh-G-CSF (NEUPOGEN) and the vehicle control (150 mM NaCl+20 mM NaOAc+0.004% Tween-20); each manufactured in a manner that was acceptable for use in animals via the designated routes of administration, i.v. and s.c.

Mice were given doses of G-CSF-NNT155 (NNT155 disclosed as SEQ ID NO: 2), PEG-G-CSF, rh-G-CSF (each in the amount of 125 μg/kg) and a vehicle control through i.v and s.c. administration. Mouse plasma samples were isolated. If required, the mouse plasma samples were diluted.

Then, the mouse samples were analyzed with G-CSF ELISA. The main purpose of analyzing the plasma samples via ELISA was for qualitative purposes only, and not for quantitative purposes (i.e., not to obtain extremely precise blood plasma level concentrations). The G-CSF ELISA results either provided a qualitative affirmation that the test article was present in the plasma or a qualitative repudiation that the test article was not in the plasma. The plasma samples were analyzed in triplicate, using two dilutions.

The results were that intravenously administered G-CSF-NNT155 (NNT155 disclosed as SEQ ID NO: 2) could be detected out to 72 hours, whereas PEG-G-CSF could only be detected out to 24 hours. In addition, both subcutaneously administered G-CSF-NNT155 (NNT155 disclosed as SEQ ID NO: 2) and PEG-G-CSF could be detected out to 72 hours. Subcutaneously administered rh-G-CSF could be detected at the 15-minute and 2-hour sampling time points.

4.B. A Single Dose Comparison of G-CSF-NNT155 (NNT155 Disclosed as SEQ ID NO: 2) and PEG-G-CSF on the Hematopoietic Effects in Mice In another evaluation of the bioavailability and efficacy of G-CSF-NNT155 (NNT155 disclosed as SEQ ID NO: 2), hematology analysis involving white blood cell and neutrophil count measurements was performed on plasma samples obtained from mice that were given doses of G-CSF-NNT155 (NNT155 disclosed as SEQ ID NO: 2), PEG-G-CSF and rh-G-CSF through i.v. and s.c. administration.

Test and control articles were the same as for the above G-CSF ELISA evaluation. The procedures for obtaining plasma samples were also the same as for the G-CSF ELISA evaluation. Hematology analysis results were as follows.

The white blood cell count mean data for the vehicle control ranged from $0.76\times10^3/\mu L$ to $4.35\times10^3/\mu L$ and $1.27\times10^3/\mu L$ to $4.25\times10^3/\mu L$ for the i.v. and s.c. administration, respectively. The mean absolute neutrophil count data for the vehicle control ranged from $0.11\times10^3/\mu L$ to $0.55\times10^3/\mu L$ and $0.29\times10^3/\mu L$ to $0.35\times10^3/\mu L$ for i.v. and s.c. administration, respectively.

The mean white blood cell count for G-CSF-NNT155 (NNT155 disclosed as SEQ ID NO: 2) increased from $1.44\times10^3/\mu L$, 15 minutes post-dose to $11.45\times10^3/\mu L$, 72 hours post i.v. administration. The mean white blood cell count for G-CSF-NNT155 (NNT155 disclosed as SEQ ID NO: 2) increased from $3.15\times10^3/\mu L$, 15 minutes post-dose to $11.45\times10^3/\mu L$, 72 hours post s.c. administration. Similarly, mean absolute neutrophil count data for G-CSF-NNT155 (NNT155 disclosed as SEQ ID NO: 2) increased from $0.04\times10^3/\mu L$, 15 minutes post-dose to $4.24\times10^3/\mu L$, 72 hours post i.v. administration. The mean absolute neutrophil count for G-CSF-NNT155 (NNT155 disclosed as SEQ ID NO: 2) increased from $0.25\times10^3/\mu L$, at 15 minutes post-dose to $2.04\times10^3/\mu L$, at 72 hours post administration and decreasing to $0.14\times10^3/\mu L$ for the s.c. route of administration at 120 hours post administration.

The mean white blood cell count for PEG-G-CSF (NEULASTA) increased from $1.36\times10^3/\mu L$, at 15 minutes post-dose to $6.03\times10^3/\mu L$, at 24 hours post administration, and then decreased to $3.01\times10^3/\mu L$, at 72 hour post i.v. administration. The mean white blood cell count for PEG-G-CSF (NEULASTA) increased from $1.47\times10^3/\mu L$, at 15 minutes post-dose to $4.58\times10^3/\mu L$, at 24 hours post administration, and then decreased to $2.47\times10^3/\mu L$, at 120 hours post s.c. administration. The mean absolute neutrophil count for PEG-G-CSF (NEULASTA) increased from $0.05\times10^3/\mu L$, at 15 minutes post-dose to $1.83\times10^3/\mu L$, at 24 hours post administration, and then decreased to $0.20\times10^3/\mu L$, at 72 hours post i.v. administration. The mean absolute neutrophil count for PEG-G-CSF (NEULASTA) increased from $0.18\times10^3/\mu L$, at 15 minutes post-dose to $1.04\times10^3/\mu L$, at 24 hours post administration and then decreased to $0.22\times10^3/\mu L$, 120 hours post s.c. administration.

The mean white blood cell count for rh-G-CSF (NEUPOGEN) decreased from $1.30\times10^3/\mu L$, at 15 minutes post-dose to $1.19\times10^3/\mu L$ at 2 hours post s.c. administration. The mean absolute neutrophil count for rh-G-CSF (NEUPOGEN) increased from $0.11\times10^3/\mu L$, at 15 minutes post-dose to $0.49\times10^3/\mu L$ at 2 hours post s.c. route of administration.

The result showed that intravenous administration of G-CSF-NNT155 (disclosed as SEQ ID NO: 2) demonstrated a substantial increase in white blood cell counts, through 72 hours post-dose, which correlated directly to an increase in absolute neutrophil counts. This mean increase exceeded the white blood cell count of the vehicle control by approximately 260%. Similarly, a mean increase in the white blood cell count for the s.c. administration of G-CSF-NNT155 (NNT155 disclosed as SEQ ID NO: 2) exceeded that of both the vehicle control and PEG-G-CSF by approximately 295%, 72 hours post-dose. However, both the mean white blood cell count and the mean absolute neutrophil count returned to that of both the vehicle control and PEG-G-CSF at 120 hours post-dose.

In some embodiments, the peptide contains the sequence NNT, NNNNT (SEQ ID NO: 182) or NNNNNT (SEQ ID NO: 183), and n is an integer of about 150 to about 160. In some of these embodiments, the biologically active protein is G-CSF.

All publications cited in the specification are indicative of the level of skill of those skilled in the art to which this invention pertains. All these publications are herein incorporated by reference to the same extent as if each individual publication were specifically and individually indicated as being incorporated by reference.

Although the invention herein has been described with reference to particular embodiments, it is to be understood that these embodiments are merely illustrative of the principles and applications of the present invention. It is therefore to be understood that numerous modifications may be made to the illustrative embodiments and that other arrangements may be devised without departing from the spirit and scope of the present invention as defined by the appended claims.

TABLE 1

| Peptide Motifs having N(Asn) as the Major Constituent (SEQ ID NOS: 184-904, respectively, in order of appearance) |
|---|
| NNT, TNN, NTN, NNNT, TNNN, NTNN, NNTN, NNNNT, TNNNN, NTNNN, NNTNN, NNNTN, NNNTT, TTNNN, TNTNN, TNNTN, TNNNT, NTTNN, |
| NTNTN, NTNNT, NNTTN, NNTNT, NNNNNT, TNNNNN, NTNNNN, NNTNNN, |
| NNNTNN, NNNNTN, NNNNTT, TTNNNN, TNTNNN, TNNTNN, TNNNTN, |
| TNNNNT, NTTNNN, NTNTNN, NTNNTN, NTNNNT, NNTTNN, NNTNTN, |
| NNTNNT, NNNTTN, NNNTNT, NNNNTTT, TTTNNNN, TNTTNNN, TNTNTNN, |
| TNTNNTN, TNTNNNT, TNNTTNN, TNNTNTN, TNNTNNT, TNNNTNT, |
| TNNNTTN, TNNNNTT, TTNTNNN, TTNNTNN, TTNNNTN, TTNNNNT, |
| NTTTNNN, NTTNTNN, NTTNNTN, NTTNNNT, NTNTTNN, NTNNTTN, |
| NTNNNTT, NTNTNTN, NTNTNNT, NTNNTNT, NNTTTNN, NNTTNTN, |
| NNTTNNT, NNTNTTN, NNTNTNT, NNTNNTT, NNNTTTN, NNNTTNT, |
| NNNTNTT, NNNNNTT, TTNNNNN, TNTNNNN, TNNTNNN, TNNNTNN, |
| TNNNNTN, TNNNNNT, NTTNNNN, NTNTNNN, NTNNTNN, NTNNNTN, |
| NTNNNNT, NNTTNNN, NNTNTNN, NNTNNTN, NNTNNNT, NNNTTNN, |
| NNNTNTN, NNNTNNT, NNNNTTN, NNNNTNT NNNNNNT, TNNNNNN, |
| NTNNNNN, NNTNNNN, NNNTNNN, NNNNTNN, NNNNNTN, NNA, ANN, NAN, |
| NNNA, ANNN, NANN, NNAN, NNNNA, ANNNN, NANNN, NNANN, NNNAN, |
| NNNAA, AANNN, ANANN, ANNAN, ANNNA, NAANN, NANAN, NANNA, |
| NNAAN, NNANA, NNNNNA, ANNNNN, NANNNN, NNANNN, NNNANN, |
| NNNNAN, NNNNAA, AANNNN, ANANNN, ANNANN, ANNNAN, ANNNNA, |
| NAANNN, NANANN, NANNAN, NANNNA, NNAANN, NNANAN, NNANNA, |
| NNNAAN, NNNANA, NNNNAAA, AAANNNN, ANAANNN, ANANANN, ANANNAN, |
| ANANNNA, ANNAANN, ANNANAN, ANNANNA, ANNNANA, ANNNAAN, |
| ANNNNAA, AANANNN, AANNANN, AANNNAN, AANNNNA, NAAANNN, |
| NAANANN, NAANNAN, NAANNNA, NANAANN, NANNAAN, NANNNAA, |
| NANANAN, NANANNA, NANNANA, NNAAANN, NNAANAN, NNAANNA, |
| NNANAAN, NNANANA, NNANNAA, NNNAAAN, NNNAANA, NNNANAA, |
| NNNNNAA, AANNNNN, ANANNNN, ANNANNN, ANNNANN, ANNNNAN, |
| ANNNNNA, NAANNNN, NANANNN, NANNANN, NANNNAN, NANNNNA, |
| NNAANNN, NNANANN, NNANNAN, NNANNNA, NNNAANN, NNNANAN, |
| NNNANNA, NNNNAAN, NNNNANA NNNNNNA, ANNNNNN, NANNNNN, |
| NNANNNN, NNNANNN, NNNNANN, NNNNNAN, NNS, SNN, NSN, NNNS, |
| SNNN, NSNN, NNSN, NNNNS, SNNNN, NSNNN, NNSNN, NNNSN, NNNSS, |
| SSNNN, SNSNN, SNNSN, SNNNS, NSSNN, NSNSN, NSNNS, NNSSN, |
| NNSNS, NNNNNS, SNNNNN, NSNNNN, NNSNNN, NNNSNN, NNNNSN, |
| NNNNSS, SSNNNN, SNSNNN, SNNSNN, SNNNSN, SNNNNS, NSSNNN, |
| NSNSNN, NSNNSN, NSNNNS, NNSSNN, NNSNSN, NNSNNS, NNNSSN, |
| NNNSNS, NNNNSSS, SSSNNNN, SNSSNNN, SNSNSNN, SNSNNSN, |
| SNSNNNS, SNNSSNN, SNNSNSN, SNNSNNS, SNNNSNS, SNNNSSN, |

TABLE 1-continued

| Peptide Motifs having N(Asn) as the Major Constituent (SEQ ID NOS: 184-904, respectively, in order of appearance) |
|---|
| SNNNNSS, SSNSNNN, SSNNSNN, SSNNNSN, SSNNNNS, NSSSNNN, |
| NSSNSNN, NSSNNSN, NSSNNNS, NSNSSNN, NSNNSSN, NSNNNSS, |
| NSNSNSN, NSNSNNS, NSNNSNS, NNSSSNN, NNSSNSN, NNSSNNS, |
| NNSNSSN, NNSNSNS, NNSNNSS, NNNSSSN, NNNSSNS, NNNSNSS, |
| NNNNNSS, SSNNNNN, SNSNNNN, SNNSNNN, SNNNSNN, SNNNNSN, |
| SNNNNNS, NSSNNNN, NSNSNNN, NSNNSNN, NSNNNSN, NSNNNNS, |
| NNSSNNN, NNSNSNN, NNSNNSN, NNSNNNS, NNNSSNN, NNNSNSN, |
| NNNSNNS, NNNNSSN, NNNNSNS NNNNNNS, SNNNNNN, NSNNNNN, |
| NNSNNNN, NNNSNNN, NNNNSNN, NNNNNSN, NNQ, QNN, NQN, NNNQ, |
| QNNN, NQNN, NNQN, NNNNQ, QNNNN, NQNNN, NNQNN, NNNQN, NNNQQ, |
| QQNNN, QNQNN, QNNQN, QNNNQ, NQQNN, NQNQN, NQNNQ, NNQQN, |
| NNQNQ, NNNNNQ, QNNNNN, NQNNNN, NNQNNN, NNNQNN, NNNNQN, |
| NNNNQQ, QQNNNN, QNQNNN, QNNQNN, QNNNQN, QNNNNQ, NQQNNN, |
| NQNQNN, NQNNQN, NQNNNQ, NNQQNN, NNQNQN, NNQNNQ, NNNQQN, |
| NNNQNQ, NNNNQQQ, QQQNNNN, QNQQNNN, QNQNQNN, QNQNNQN, |
| QNQNNNQ, QNNQQNN, QNNQNQN, QNNQNNQ, QNNNQNQ, QNNNQQN, |
| QNNNNQQ, QQNQNNN, QQNNQNN, QQNNNQN, QQNNNNQ, NQQQNNN, |
| NQQNQNN, NQQNNQN, NQQNNNQ, NQNQQNN, NQNNQQN, NQNNNQQ, |
| NQNQNQN, NQNQNNQ, NQNNQNQ, NNQQQNN, NNQQNQN, NNQQNNQ, |
| NNQNQQN, NNQNQNQ, NNQNNQQ, NNNQQQN, NNNQQNQ, NNNQNQQ, |
| NNNNNQQ, QQNNNNN, QNQNNNN, QNNQNNN, QNNNQNN, QNNNNQN, |
| QNNNNNQ, NQQNNNN, NQNQNNN, NQNNQNN, NQNNNQN, NQNNNNQ, |
| NNQQNNN, NNQNQNN, NNQNNQN, NNQNNNQ, NNNQQNN, NNNQNQN, |
| NNNQNNQ, NNNNQQN, NNNNQNQ NNNNNNQ, QNNNNNN, NQNNNNN, |
| NNQNNNN, NNNQNNN, NNNNQNN, NNNNNQN, NNE, ENN, NEN, NNNE, |
| ENNN, NENN, NNEN, NNNNE, ENNNN, NENNN, NNENN, NNNEN, NNNEE, |
| EENNN, ENENN, ENNEN, ENNNE, NEENN, NENEN, NENNE, NNEEN, |
| NNENE, NNNNNE, ENNNNN, NENNNN, NNENNN, NNNENN, NNNNEN, |
| NNNNEE, EENNNN, ENENNN, ENNENN, ENNNEN, ENNNNE, NEENNN, |
| NENENN, NENNEN, NENNNE, NNEENN, NNENEN, NNENNE, NNNEEN, |
| NNNENE, NNNNEEE, EEENNNN, ENEENNN, ENENENN, ENENNEN, |
| ENENNNE, ENNEENN, ENNENEN, ENNENNE, ENNNENE, ENNNEEN, |
| ENNNNEE, EENENNN, EENNENN, EENNNEN, EENNNNE, NEEENNN, |
| NEENENN, NEENNEN, NEENNNE, NENEENN, NENNEEN, NENNNEE, |
| NENENEN, NENENNE, NENNENE, NNEEENN, NNEENEN, NNEENNE, |
| NNENEEN, NNENENE, NNENNEE, NNNEEEN, NNNEENE, NNNENEE, |
| NNNNNEE, EENNNNN, ENENNNN, ENNENNN, ENNNENN, ENNNNEN, |
| ENNNNNE, NEENNNN, NENENNN, NENNENN, NENNNEN, NENNNNE, |
| NNEENNN, NNENENN, NNENNEN, NNENNNE, NNNEENN, NNNENEN, |

TABLE 1-continued

| Peptide Motifs having N(Asn) as the Major Constituent (SEQ ID NOS: 184-904, respectively, in order of appearance) |
|---|
| NNNENNE, NNNNEEN, NNNNENE NNNNNNE, ENNNNNN, NENNNNN, NNENNNN, NNNENNN, NNNNENN, NNNNNEN, NNH, HNN, NHN, NNNH, HNNN, NHNN, NNHN, NNNNH, HNNNN, NHNNN, NNHNN, NNNHN, NNNHH, HHNNN, HNHNN, HNNHN, HNNNH, NHHNN, NHNHN, NHNNH, NNHHN, NNHNH, NNNNNH, HNNNNN, NHNNNN, NNHNNN, NNNHNN, NNNNHN, NNNNHH, HHNNNN, HNHNNN, HNNHNN, HNNNHN, HNNNNH, NHHNNN, NHNHNN, NHNNHN, NHNNNH, NNHHNN, NNHNHN, NNHNNH, NNNHHN, NNNHNH, NNNNHHH, HHHNNNN, HNHHNNN, HNHNHNN, HNHNNHN, HNHNNNH, HNNHHNN, HNNHNHN, HNNHNNH, HNNNHNH, HNNNHHN, HNNNNHH, HHNHNNN, HHNNHNN, HHNNNHN, HHNNNNH, NHHHNNN, NHHNHNN, NHHNNHN, NHHNNNH, NHNHHNN, NHNNHHN, NHNNNHH, NHNHNHN, NHNHNNH, NHNNHNH, NNHHHNN, NNHHNHN, NNHHNNH, NNHNHHN, NNHNHNH, NNHNNHH, NNNHHHN, NNNHHNH, NNNHNHH, NNNNNHH, HHNNNNN, HNHNNNN, HNNHNNN, HNNNHNN, HNNNNHN, HNNNNNH, NHHNNNN, NHNHNNN, NHNNHNN, NHNNNHN, NHNNNNH, NNHHNNN, NNHNHNN, NNHNNHN, NNHNNNH, NNNHHNN, NNNHNHN, NNNHNNH, NNNNHHN, NNNNHNH NNNNNNH, HNNNNNN, NHNNNNN, NNHNNNN, NNNHNNN, NNNNHNN, NNNNNHN, NND, DNN, NDN, NNND, DNNN, NDNN, NNDN, NNNND, DNNNN, NDNNN, NNDNN, NNNDN, NNNDD, DDNNN, DNDNN, DNNDN, DNNND, NDDNN, NDNDN, NDNND, NNDDN, NNDND, NNNNND, DNNNNN, NDNNNN, NNDNNN, NNNDNN, NNNNDN, NNNNDD, DDNNNN, DNDNNN, DNNDNN, DNNNDN, DNNNND, NDDNNN, NDNDNN, NDNNDN, NDNNND, NNDDNN, NNDNDN, NNDNND, NNNDDN, NNNDND, NNNNDDD, DDDNNNN, DNDDNNN, DNDNDNN, DNDNNDN, DNDNNND, DNNDDNN, DNNDNDN, DNNDNND, DNNNDND, DNNNDDN, DNNNNDD, DDNDNNN, DDNNDNN, DDNNNDN, DDNNNND, NDDDNNN, NDDNDNN, NDDNNDN, NDDNNND, NDNDDNN, NDNNDDN, NDNNNDD, NDNDNDN, NDNDNND, NDNNDND, NNDDDNN, NNDDNDN, NNDDNND, NNDNDDN, NNDNDND, NNDNNDD, NNNDDDN, NNNDDND, NNNDNDD, NNNNNDD, DDNNNNN, DNDNNNN, DNNDNNN, DNNNDNN, DNNNNDN, DNNNNND, NDDNNNN, NDNDNNN, NDNNDNN, NDNNNDN, NDNNNND, NNDDNNN, NNDNDNN, NNDNNDN, NNDNNND, NNNDDNN, NNNDNDN, NNNDNND, NNNNDDN, NNNNDND NNNNNND, DNNNNNN, NDNNNNN, NNDNNNN, NNNDNNN, NNNNDNN, and NNNNNDN. |

TABLE 2

| Peptide Motifs having G (Gly) as the Major Constituent (SEQ ID NOS: 905-1728, respectively, in order of appearance) |
|---|
| GGT, TGG, GTG, GGGT, TGGG, GTGG, GGTG, GGGGT, TGGGG, GTGGG, GGTGG, GGGTG, GGGTT, TTGGG, TGTGG, TGGTG, TGGGT, GTTGG, GTGTG, GTGGT, GGTTG, GGTGT, GGGGGT, TGGGGG, GTGGGG, GGTGGG, GGGTGG, GGGGTG, GGGGTT, TTGGGG, TGTGGG, TGGTGG, TGGGTG, TGGGGT, GTTGGG, GTGTGG, GTGGTG, GTGGGT, GGTTGG, GGTGTG, GGTGGT, GGGTTG, GGGTGT, GGGGTTT, TTTGGGG, TGTTGGG, TGTGTGG, TGTGGTG, TGTGGGT, TGGTTGG, TGGTGTG, TGGTGGT, TGGGTGT, TGGGTTG, TGGGGTT, TTGTGGG, TTGGTGG, TTGGGTG, TTGGGGT, GTTTGGG, GTTGTGG, GTTGGTG, GTTGGGT, GTGTTGG, GTGGTTG, GTGGGTT, GTGTGTG, GTGTGGT, GTGGTGT, GGTTTGG, GGTTGTG, GGTTGGT, GGTGTTG, GGTGTGT, GGTGGTT, GGGTTTG, GGGTTGT, GGGTGTT, GGGGGTT, TTGGGGG, TGTGGGG, TGGTGGG, TGGGTGG, TGGGGTG, TGGGGGT, GTTGGGG, GTGTGGG, GTGGTGG, GTGGGTG, GTGGGGT, GGTTGGG, GGTGTGG, GGTGGTG, GGTGGGT, GGGTTGG, GGGTGTG, GGGTGGT, GGGGTTG, GGGGTGT GGGGGGT, TGGGGGG, GTGGGGG, GGTGGGG, GGGTGGG, GGGGTGG, GGGGGTG, GGA, AGG, GAG, GGGA, AGGG, GAGG, GGAG, GGGGA, AGGGG, GAGGG, GGAGG, GGGAG, GGGAA, AAGGG, AGAGG, AGGAG, AGGGA, GAAGG, GAGAG, GAGGA, GGAAG, GGAGA, GGGGGA, AGGGGG, GAGGGG, GGAGGG, GGGAGG, GGGGAG, GGGGAA, AAGGGG, AGAGGG, AGGAGG, AGGGAG, AGGGGA, GAAGGG, GAGAGG, GAGGAG, GAGGGA, GGAAGG, GGAGAG, GGAGGA, GGGAAG, GGGAGA, GGGGAAA, AAAGGGG, AGAAGGG, AGAGAGG, AGAGGAG, AGAGGGA, AGGAAGG, AGGAGAG, AGGAGGA, AGGGAGA, AGGGAAG, AGGGGAA, AAGAGGG, AAGGAGG, AAGGGAG, AAGGGGA, GAAAGGG, GAAGAGG, GAAGGAG, GAAGGGA, GAGAAGG, GAGGAAG, GAGGGAA, GAGAGAG, GAGAGGA, GAGGAGA, GGAAAGG, GGAAGAG, GGAAGGA, GGAGAAG, GGAGAGA, GGAGGAA, GGGAAAG, GGGAAGA, GGGAGAA, GGGGGAA, AAGGGGG, AGAGGGG, AGGAGGG, AGGGAGG, AGGGGAG, AGGGGGA, GAAGGGG, GAGAGGG, GAGGAGG, GAGGGAG, GAGGGGA, GGAAGGG, GGAGAGG, GGAGGAG, GGAGGGA, GGGAAGG, GGGAGAG, GGGAGGA, GGGGAAG, GGGGAGA GGGGGGA, AGGGGGG, GAGGGGG, GGAGGGG, GGGAGGG, GGGGAGG, GGGGGAG, GGS, SGG, GSG, GGGS, SGGG, GSGG, GGSG, GGGGS, SGGGG, GSGGG, GGSGG, GGGSG, GGGSS, SSGGG, SGSGG, SGGSG, SGGGS, GSSGG, GSGSG, GSGGS, GGSSG, GGSGS, GGGGGS, SGGGGG, GSGGGG, GGSGGG, GGGSGG, GGGGSG, GGGGSS, SSGGGG, SGSGGG, SGGSGG, SGGGSG, SGGGGS, GSSGGG, GSGSGG, GSGGSG, GSGGGS, GGSSGG, GGSGSG, GGSGGS, GGGSSG, GGGSGS, GGGGSSS, SSSGGGG, SGSSGGG, SGSGSGG, SGSGGSG, SGSGGGS, SGGSSGG, SGGSGSG, SGGSGGS, SGGGSGS, SGGGSSG, |

TABLE 2-continued

| Peptide Motifs having G (Gly) as the Major Constituent (SEQ ID NOS: 905-1728, respectively, in order of appearance) |
|---|
| SGGGGSS, SSGSGGG, SSGGSGG, SSGGGSG, SSGGGGS, GSSSGGG, GSSGSGG, GSSGGSG, GSSGGGS, GSGSSGG, GSGGSSG, GSGGGSS, GSGSGSG, GSGSGGS, GSGGSGS, GGSSSGG, GGSSGSG, GGSSGGS, GGSGSSG, GGSGSGS, GGSGGSS, GGGSSSG, GGGSSGS, GGGSGSS, GGGGGSS, SSGGGGG, SGSGGGG, SGGSGGG, SGGGSGG, SGGGGSG, SGGGGGS, GSSGGGG, GSGSGGG, GSGGSGG, GSGGGSG, GSGGGGS, GGSSGGG, GGSGSGG, GGSGGSG, GGSGGGS, GGGSSGG, GGGSGSG, GGGSGGS, GGGGSSG, GGGGSGS, GGGGGGS, SGGGGGG, GSGGGGG, GGSGGGG, GGGSGGG, GGGGSGG, GGGGGSG, GGQ, QGG, GQG, GGGQ, QGGG, GQGG, GGQG, GGGGQ, QGGGG, GQGGG, GGQGG, GGGQG, GGGQQ, QQGGG, QGQGG, QGGQG, QGGGQ, GQQGG, GQGQG, GQGGQ, GGQQG, GGQGQ, GGGGGQ, QGGGGG, GQGGGG, GGQGGG, GGGQGG, GGGGQG, GGGGQQ, QQGGGG, QGQGGG, QGGQGG, QGGGQG, QGGGGQ, GQQGGG, GQGQGG, GQGGQG, GQGGGQ, GGQQGG, GGQGQG, GGQGGQ, GGGQQG, GGGQGQ, GGGGQQQ, QQQGGGG, QGQQGGG, QGQGQGG, QGQGGQG, QGQGGGQ, QGGQQGG, QGGQGQG, QGGQGGQ, QGGGQGQ, QGGGQQG, QGGGGQQ, QQGQGGG, QQGGQGG, QQGGGQG, QQGGGGQ, GQQQGGG, GQQGQGG, GQQGGQG, GQQGGGQ, GQGQQGG, GQGGQQG, GQGGGQQ, GQGQGQG, GQGQGGQ, GQGGQGQ, GGQQQGG, GGQQGQG, GGQQGGQ, GGQGQQG, GGQGQGQ, GGQGGQQ, GGGQQQG, GGGQQGQ, GGGQGQQ, GGGGGQQ, QQGGGGG, QGQGGGG, QGGQGGG, QGGGQGG, QGGGGQG, QGGGGGQ, GQQGGGG, GQGQGGG, GQGGQGG, GQGGGQG, GQGGGGQ, GGQQGGG, GGQGQGG, GGQGGQG, GGQGGGQ, GGGQQGG, GGGQGQG, GGGQGGQ, GGGGQQG, GGGGQGQ GGGGGGQ, QGGGGGG, GQGGGGG, GGQGGGG, GGGQGGG, GGGGQGG, GGGGGQG, GGE, EGG, GEG, GGGE, EGGG, GEGG, GGEG, GGGGE, EGGGG, GEGGG, GGEGG, GGGEG, GGGEE, EEGGG, EGEGG, EGGEG, EGGGE, GEEGG, GEGEG, GEGGE, GGEEG, GGEGE, GGGGGE, EGGGGG, GEGGGG, GGEGGG, GGGEGG, GGGGEG, GGGGEE, EEGGGG, EGEGGG, EGGEGG, EGGGEG, EGGGGE, GEEGGG, GEGEGG, GEGGEG, GEGGGE, GGEEGG, GGEGEG, GGEGGE, GGGEEG, GGGEGE, GGGGEEE, EEEGGGG, EGEEGGG, EGEGEGG, EGEGGEG, EGEGGGE, EGGEEGG, EGGEGEG, EGGEGGE, EGGGEGE, EGGGEEG, EGGGGEE, EEGEGGG, EEGGEGG, EEGGGEG, EEGGGGE, GEEEGGG, GEEGEGG, GEEGGEG, GEEGGGE, GEGEEGG, GEGGEEG, GEGGGEE, GEGEGEG, GEGEGGE, GEGGEGE, GGEEEGG, GGEEGEG, GGEEGGE, GGEGEEG, GGEGEGE, GGEGGEE, GGGEEEG, GGGEEGE, GGGEGEE, GGGGGEE, EEGGGGG, EGEGGGG, EGGEGGG, EGGGEGG, EGGGGEG, EGGGGGE, GEEGGGG, GEGEGGG, GEGGEGG, GEGGGEG, GEGGGGE, |

TABLE 2-continued

| Peptide Motifs having G (Gly) as the Major Constituent (SEQ ID NOS: 905-1728, respectively, in order of appearance) |
|---|
| GGEEGGG, GGEGEGG, GGEGGEG, GGEGGGE, GGGEEGG, GGGEGEG, |
| GGGEGGE, GGGGEEG, GGGGEGE GGGGGGE, EGGGGGG, GEGGGGG, |
| GGEGGGG, GGGEGGG, GGGGEGG, GGGGGEG, GGH, HGG, GHG, GGGH, |
| HGGG, GHGG, GGHG, GGGGH, HGGGG, GHGGG, GGHGG, GGGHG, GGGHH, |
| HHGGG, HGHGG, HGGHG, HGGGH, GHHGG, GHGHG, GHGGH, GGHHG, |
| GGHGH, GGGGGH, HGGGGG, GHGGGG, GGHGGG, GGGHGG, GGGGHG, |
| GGGGHH, HHGGGG, HGHGGG, HGGHGG, HGGGHG, HGGGGH, GHHGGG, |
| GHGHGG, GHGGHG, GHGGGH, GGHHGG, GGHGHG, GGHGGH, GGGHHG, |
| GGGHGH, GGGGHHH, HHHGGGG, HGHHGGG, HGHGHGG, HGHGGHG, |
| HGHGGGH, HGGHHGG, HGGHGHG, HGGHGGH, HGGGHGH, HGGGHHG, |
| HGGGGHH, HHGHGGG, HHGGHGG, HHGGGHG, HHGGGGH, GHHHGGG, |
| GHHGHGG, GHHGGHG, GHHGGGH, GHGHHGG, GHGGHHG, GHGGGHH, |
| GHGHGHG, GHGHGGH, GHGGHGH, GGHHHGG, GGHHGHG, GGHHGGH, |
| GGHGHHG, GGHGHGH, GGHGGHH, GGGHHHG, GGGHHGH, GGGHGHH, |
| GGGGGHH, HHGGGGG, HGHGGGG, HGGHGGG, HGGGHGG, HGGGGHG, |
| HGGGGGH, GHHGGGG, GHGHGGG, GHGGHGG, GHGGGHG, GHGGGGH, |
| GGHHGGG, GGHGHGG, GGHGGHG, GGHGGGH, GGGHHGG, GGGHGHG, |
| GGGHGGH, GGGGHHG, GGGGHGH GGGGGGH, HGGGGGG, GHGGGGG, |
| GGHGGGG, GGGHGGG, GGGGHGG, GGGGGHG, GGN, NGG, GNG, GGGN, |
| NGGG, GNGG, GGNG, GGGGN, NGGGG, GNGGG, GGNGG, GGGNG, GGGNN, |
| NNGGG, NGNGG, NGGNG, NGGGN, GNNGG, GNGNG, GNGGN, GGNNG, |
| GGNGN, GGGGGN, NGGGGG, GNGGGG, GGNGGG, GGGNGG, GGGGNG, |
| GGGGNN, NNGGGG, NGNGGG, NGGNGG, NGGGNG, NGGGGN, GNNGGG, |
| GNGNGG, GNGGNG, GNGGGN, GGNNGG, GGNGNG, GGNGGN, GGGNNG, |
| GGGNGN, GGGGNNN, NNNGGGG, NGNNGGG, NGNGNGG, NGNGGNG, |
| NGNGGGN, NGGNNGG, NGGNGNG, NGGNGGN, NGGGNGN, NGGGNNG, |
| NGGGGNN, NNGNGGG, NNGGNGG, NNGGGNG, NNGGGGN, GNNNGGG, |
| GNNGNGG, GNNGGNG, GNNGGGN, GNGNNGG, GNGGNNG, GNGGGNN, |
| GNGNGNG, GNGNGGN, GNGGNGN, GGNNNGG, GGNNGNG, GGNNGGN, |
| GGNGNNG, GGNGNGN, GGNGGNN, GGGNNNG, GGGNNGN, GGGNGNN, |
| GGGGGNN, NNGGGGG, NGNGGGG, NGGNGGG, NGGGNGG, NGGGGNG, |
| NGGGGGN, GNNGGGG, GNGNGGG, GNGGNGG, GNGGGNG, GNGGGGN, |
| GGNNGGG, GGNGNGG, GGNGGNG, GGNGGGN, GGGNNGG, GGGNGNG, |
| GGGNGGN, GGGGNNG, GGGGNGN GGGGGGN, NGGGGGG, GNGGGGG, |
| GGNGGGG, GGGNGGG, GGGGNGG, GGGGGNG, GGD, DGG, GDG, GGGD, |
| DGGG, GDGG, GGDG, GGGGD, DGGGG, GDGGG, GGDGG, GGGDG, GGGDD, |
| DDGGG, DGDGG, DGGDG, DGGGD, GDDGG, GDGDG, GDGGD, GGDDG, |
| GGDGD, GGGGGD, DGGGGG, GDGGGG, GGDGGG, GGGDGG, GGGGDG, |
| GGGGDD, DDGGGG, DGDGGG, DGGDGG, DGGGDG, DGGGGD, GDDGGG, |

TABLE 2-continued

| Peptide Motifs having G (Gly) as the Major Constituent (SEQ ID NOS: 905-1728, respectively, in order of appearance) |
|---|
| GDGDGG, GDGGDG, GDGGGD, GGDDGG, GGDGDG, GGDGGD, GGGDDG, GGGDGD, GGGGDDD, DDDGGGG, DGDDGGG, DGDGDGG, DGDGGDG, DGDGGGD, DGGDDGG, DGGDGDG, DGGDGGD, DGGGDGD, DGGGDDG, DGGGGDD, DDGDGGG, DDGGDGG, DDGGGDG, DDGGGGD, GDDDGGG, GDDGDGG, GDDGGDG, GDDGGGD, GDGDDGG, GDGGDDG, GDGGGDD, GDGDGDG, GDGDGGD, GDGGDGD, GGDDDGG, GGDDGDG, GGDDGGD, GGDGDDG, GGDGDGD, GGDGGDD, GGGDDDG, GGGDDGD, GGGDGDD, GGGGGDD, DDGGGGG, DGDGGGG, DGGDGGG, DGGGDGG, DGGGGDG, DGGGGGD, GDDGGGG, GDGDGGG, GDGGDGG, GDGGGDG, GDGGGGD, GGDDGGG, GGDGDGG, GGDGGDG, GGDGGGD, GGGDDGG, GGGDGDG, GGGDGGD, GGGGDDG, GGGGDGD GGGGGGD, DGGGGGG, GDGGGGG, GGDGGGG, GGGDGGG, GGGGDGG, and GGGGGDG. |

TABLE 3

| Peptide Motifs having Q (Gln) as the Major Constituent (SEQ ID NOS: 1729-2449, respectively, in order of appearance) |
|---|
| QQT, TQQ, QTQ, QQQT, TQQQ, QTQQ, QQTQ, QQQQT, TQQQQ, QTQQQ, QQTQQ, QQQTQ, QQQTT, TTQQQ, TQTQQ, TQQTQ, TQQQT, QTTQQ, QTQTQ, QTQQT, QQTTQ, QQTQT, QQQQQT, TQQQQQ, QTQQQQ, QQTQQQ, QQQTQQ, QQQQTQ, QQQQTT, TTQQQQ, TQTQQQ, TQQTQQ, TQQQTQ, TQQQQT, QTTQQQ, QTQTQQ, QTQQTQ, QTQQQT, QQTTQQ, QQTQTQ, QQTQQT, QQQTTQ, QQQTQT, QQQQTTT, TTTQQQQ, TQTTQQQ, TQTQTQQ, TQTQQTQ, TQTQQQT, TQQTTQQ, TQQTQTQ, TQQTQQT, TQQQTQT, TQQQTTQ, TQQQQTT, TTQTQQQ, TTQQTQQ, TTQQQTQ, TTQQQQT, QTTTQQQ, QTTQTQQ, QTTQQTQ, QTTQQQT, QTQTTQQ, QTQQTTQ, QTQQQTT, QTQTQTQ, QTQTQQT, QTQQTQT, QQTTTQQ, QQTTQTQ, QQTTQQT, QQTQTTQ, QQTQTQT, QQTQQTT, QQQTTTQ, QQQTTQT, QQQTQTT, QQQQQTT, TTQQQQQ, TQTQQQQ, TQQTQQQ, TQQQTQQ, TQQQQTQ, TQQQQQT, QTTQQQQ, QTQTQQQ, QTQQTQQ, QTQQQTQ, QTQQQQT, QQTTQQQ, QQTQTQQ, QQTQQTQ, QQTQQQT, QQQTTQQ, QQQTQTQ, QQQTQQT, QQQQTTQ, QQQQTQT QQQQQQT, TQQQQQQ, QTQQQQQ, QQTQQQQ, QQQTQQQ, QQQQTQQ, QQQQQTQ, QQA, AQQ, QAQ, QQQA, AQQQ, QAQQ, QQAQ, QQQQA, AQQQQ, QAQQQ, QQAQQ, QQQAQ, QQQAA, AAQQQ, AQAQQ, AQQAQ, AQQQA, QAAQQ, QAQAQ, QAQQA, QQAAQ, QQAQA, QQQQQA, AQQQQQ, QAQQQQ, QQAQQQ, QQQAQQ, QQQQAQ, QQQQAA, AAQQQQ, AQAQQQ, AQQAQQ, AQQQAQ, AQQQQA, QAAQQQ, QAQAQQ, QAQQAQ, QAQQQA, QQAAQQ, QQAQAQ, QQAQQA, QQQAAQ, QQQAQA, QQQQAAA, AAAQQQQ, AQAAQQQ, AQAQAQQ, AQAQQAQ, |

TABLE 3-continued

| Peptide Motifs having Q (Gln) as the Major Constituent (SEQ ID NOS: 1729-2449, respectively, in order of appearance) |
|---|
| AQAQQQA, AQQAAQQ, AQQAQAQ, AQQAQQA, AQQQAQA, AQQQAAQ, |
| AQQQQAA, AAQAQQQ, AAQQAQQ, AAQQQAQ, AAQQQQA, QAAAQQQ, |
| QAAQAQQ, QAAQQAQ, QAAQQQA, QAQAAQQ, QAQQAAQ, QAQQQAA, |
| QAQAQAQ, QAQAQQA, QAQQAQA, QQAAAQQ, QQAAQAQ, QQAAQQA, |
| QQAQAAQ, QQAQAQA, QQAQQAA, QQQAAAQ, QQQAAQA, QQQAQAA, |
| QQQQQAA, AAQQQQQ, AQAQQQQ, AQQAQQQ, AQQQAQQ, AQQQQAQ, |
| AQQQQQA, QAAQQQQ, QAQAQQQ, QAQQAQQ, QAQQQAQ, QAQQQQA, |
| QQAAQQQ, QQAQAQQ, QQAQQAQ, QQAQQQA, QQQAAQQ, QQQAQAQ, |
| QQQAQQA, QQQQAAQ, QQQQAQA QQQQQQA, AQQQQQQ, QAQQQQQ, |
| QQAQQQQ, QQQAQQQ, QQQQAQQ, QQQQQAQ, QQS, SQQ, QSQ, QQQS, |
| SQQQ, QSQQ, QQSQ, QQQQS, SQQQQ, QSQQQ, QQSQQ, QQQSQ, QQQSS, |
| SSQQQ, SQSQQ, SQQSQ, SQQQS, QSSQQ, QSQSQ, QSQQS, QQSSQ, |
| QQSQS, QQQQQS, SQQQQQ, QSQQQQ, QQSQQQ, QQQSQQ, QQQQSQ, |
| QQQQSS, SSQQQQ, SQSQQQ, SQQSQQ, SQQQSQ, SQQQQS, QSSQQQ, |
| QSQSQQ, QSQQSQ, QSQQQS, QQSSQQ, QQSQSQ, QQSQQS, QQQSSQ, |
| QQQSQS, QQQQSSS, SSSQQQQ, SQSSQQQ, SQSQSQQ, SQSQQSQ, |
| SQSQQQS, SQQSSQQ, SQQSQSQ, SQQSQQS, SQQQSQS, SQQQSSQ, |
| SQQQQSS, SSQSQQQ, SSQQSQQ, SSQQQSQ, SSQQQQS, QSSSQQQ, |
| QSSQSQQ, QSSQQSQ, QSSQQQS, QSQSSQQ, QSQQSSQ, QSQQQSS, |
| QSQSQSQ, QSQSQQS, QSQQSQS, QQSSSQQ, QQSSQSQ, QQSSQQS, |
| QQSQSSQ, QQSQSQS, QQSQQSS, QQQSSSQ, QQQSSQS, QQQSQSS, |
| QQQQQSS, SSQQQQQ, SQSQQQQ, SQQSQQQ, SQQQSQQ, SQQQQSQ, |
| SQQQQQS, QSSQQQQ, QSQSQQQ, QSQQSQQ, QSQQQSQ, QSQQQQS, |
| QQSSQQQ, QQSQSQQ, QQSQQSQ, QQSQQQS, QQQSSQQ, QQQSQSQ, |
| QQQSQQS, QQQQSSQ, QQQQSQS QQQQQQS, SQQQQQQ, QSQQQQQ, |
| QQSQQQQ, QQQSQQQ, QQQQSQQ, QQQQQSQ, QQE, EQQ, QEQ, QQQE, |
| EQQQ, QEQQ, QQEQ, QQQQE, EQQQQ, QEQQQ, QQEQQ, QQQEQ, QQQEE, |
| EEQQQ, EQEQQ, EQQEQ, EQQQE, QEEQQ, QEQEQ, QEQQE, QQEEQ, |
| QQEQE, QQQQQE, EQQQQQ, QEQQQQ, QQEQQQ, QQQEQQ, QQQQEQ, |
| QQQQEE, EEQQQQ, EQEQQQ, EQQEQQ, EQQQEQ, EQQQQE, QEEQQQ, |
| QEQEQQ, QEQQEQ, QEQQQE, QQEEQQ, QQEQEQ, QQEQQE, QQQEEQ, |
| QQQEQE, QQQQEEE, EEEQQQQ, EQEEQQQ, EQEQEQQ, EQEQQEQ, |
| EQEQQQE, EQQEEQQ, EQQEQEQ, EQQEQQE, EQQQEQE, EQQQEEQ, |
| EQQQQEE, EEQEQQQ, EEQQEQQ, EEQQQEQ, EEQQQQE, QEEEQQQ, |
| QEEQEQQ, QEEQQEQ, QEEQQQE, QEQEEQQ, QEQQEEQ, QEQQQEE, |
| QEQEQEQ, QEQEQQE, QEQQEQE, QQEEEQQ, QQEEQEQ, QQEEQQE, |
| QQEQEEQ, QQEQEQE, QQEQQEE, QQQEEEQ, QQQEEQE, QQQEQEE, |
| QQQQQEE, EEQQQQQ, EQEQQQQ, EQQEQQQ, EQQQEQQ, EQQQQEQ, |

TABLE 3-continued

| Peptide Motifs having Q (Gln) as the Major Constituent (SEQ ID NOS: 1729-2449, respectively, in order of appearance) |
| --- |
| EQQQQQE, QEEQQQQ, QEQEQQQ, QEQQEQQ, QEQQQEQ, QEQQQQE, |
| QQEEQQQ, QQEQEQQ, QQEQQEQ, QQEQQQE, QQQEEQQ, QQQEQEQ, |
| QQQEQQE, QQQQEEQ, QQQQEQE QQQQQQE, EQQQQQQ, QEQQQQQ, |
| QQEQQQQ, QQQEQQQ, QQQQEQQ, QQQQQEQ, QQH, HQQ, QHQ, QQQH, |
| HQQQ, QHQQ, QQHQ, QQQQH, HQQQQ, QHQQQ, QQHQQ, QQQHQ, QQQHH, |
| HHQQQ, HQHQQ, HQQHQ, HQQQH, QHHQQ, QHQHQ, QHQQH, QQHHQ, |
| QQHQH, QQQQQH, HQQQQQ, QHQQQQ, QQHQQQ, QQQHQQ, QQQQHQ, |
| QQQQHH, HHQQQQ, HQHQQQ, HQQHQQ, HQQQHQ, HQQQQH, QHHQQQ, |
| QHQHQQ, QHQQHQ, QHQQQH, QQHHQQ, QQHQHQ, QQHQQH, QQQHHQ, |
| QQQHQH, QQQQHHH, HHHQQQQ, HQHHQQQ, HQHQHQQ, HQHQQHQ, |
| HQHQQQH, HQQHHQQ, HQQHQHQ, HQQHQQH, HQQQHQH, HQQQHHQ, |
| HQQQQHH, HHQHQQQ, HHQQHQQ, HHQQQHQ, HHQQQQH, QHHHQQQ, |
| QHHQHQQ, QHHQQHQ, QHHQQQH, QHQHHQQ, QHQQHHQ, QHQQQHH, |
| QHQHQHQ, QHQHQQH, QHQQHQH, QQHHHQQ, QQHHQHQ, QQHHQQH, |
| QQHQHHQ, QQHQHQH, QQHQQHH, QQQHHHQ, QQQHHQH, QQQHQHH, |
| QQQQQHH, HHQQQQQ, HQHQQQQ, HQQHQQQ, HQQQHQQ, HQQQQHQ, |
| HQQQQQH, QHHQQQQ, QHQHQQQ, QHQQHQQ, QHQQQHQ, QHQQQQH, |
| QQHHQQQ, QQHQHQQ, QQHQQHQ, QQHQQQH, QQQHHQQ, QQQHQHQ, |
| QQQHQQH, QQQQHHQ, QQQQHQH QQQQQQH, HQQQQQQ, QHQQQQQ, |
| QQHQQQQ, QQQHQQQ, QQQQHQQ, QQQQQHQ, QQN, NQQ, QNQ, QQQN, |
| NQQQ, QNQQ, QQNQ, QQQQN, NQQQQ, QNQQQ, QQNQQ, QQQNQ, QQQNN, |
| NNQQQ, NQNQQ, NQQNQ, NQQQN, QNNQQ, QNQNQ, QNQQN, QQNNQ, |
| QQNQN, QQQQQN, NQQQQQ, QNQQQQ, QQNQQQ, QQQNQQ, QQQQNQ, |
| QQQQNN, NNQQQQ, NQNQQQ, NQQNQQ, NQQQNQ, NQQQQN, QNNQQQ, |
| QNQNQQ, QNQQNQ, QNQQQN, QQNNQQ, QQNQNQ, QQNQQN, QQQNNQ, |
| QQQNQN, QQQQNNN, NNNQQQQ, NQNNQQQ, NQNQNQQ, NQNQQNQ, |
| NQNQQQN, NQQNNQQ, NQQNQNQ, NQQNQQN, NQQQNQN, NQQQNNQ, |
| NQQQQNN, NNQNQQQ, NNQQNQQ, NNQQQNQ, NNQQQQN, QNNNQQQ, |
| QNNQNQQ, QNNQQNQ, QNNQQQN, QNQNNQQ, QNQQNNQ, QNQQQNN, |
| QNQNQNQ, QNQNQQN, QNQQNQN, QQNNNQQ, QQNNQNQ, QQNNQQN, |
| QQNQNNQ, QQNQNQN, QQNQQNN, QQQNNNQ, QQQNNQN, QQQNQNN, |
| QQQQQNN, NNQQQQQ, NQNQQQQ, NQQNQQQ, NQQQNQQ, NQQQQNQ, |
| NQQQQQN, QNNQQQQ, QNQNQQQ, QNQQNQQ, QNQQQNQ, QNQQQQN, |
| QQNNQQQ, QQNQNQQ, QQNQQNQ, QQNQQQN, QQQNNQQ, QQQNQNQ, |
| QQQNQQN, QQQQNNQ, QQQQNQN QQQQQQN, NQQQQQQ, QNQQQQQ, |
| QQNQQQQ, QQQNQQQ, QQQQNQQ, QQQQQNQ, QQD, DQQ, QDQ, QQQD, |
| DQQQ, QDQQ, QQDQ, QQQQD, DQQQQ, QDQQQ, QQDQQ, QQQDQ, QQQDD, |
| DDQQQ, DQDQQ, DQQDQ, DQQQD, QDDQQ, QDQDQ, QDQQD, QQDDQ, |

TABLE 3-continued

| Peptide Motifs having Q (Gln) as the Major Constituent (SEQ ID NOS: 1729-2449, respectively, in order of appearance) |
|---|
| QQDQD, QQQQQD, DQQQQQ, QDQQQQ, QQDQQQ, QQQDQQ, QQQQDQ, |
| QQQQDD, DDQQQQ, DQDQQQ, DQQDQQ, DQQQDQ, DQQQQD, QDDQQQ, |
| QDQDQQ, QDQQDQ, QDQQQD, QQDDQQ, QQDQDQ, QQDQQD, QQQDDQ, |
| QQQDQD, QQQQDDD, DDDQQQQ, DQDDQQQ, DQDQDQQ, DQDQQDQ, |
| DQDQQQD, DQQDDQQ, DQQDQDQ, DQQDQQD, DQQQDQD, DQQQDDQ, |
| DQQQQDD, DDQDQQQ, DDQQDQQ, DDQQQDQ, DDQQQQD, QDDDQQQ, |
| QDDQDQQ, QDDQQDQ, QDDQQQD, QDQDDQQ, QDQQDDQ, QDQQQDD, |
| QDQDQDQ, QDQDQQD, QDQQDQD, QQDDDQQ, QQDDQDQ, QQDDQQD, |
| QQDQDDQ, QQDQDQD, QQDQQDD, QQQDDDQ, QQQDDQD, QQQDQDD, |
| QQQQQDD, DDQQQQQ, DQDQQQQ, DQQDQQQ, DQQQDQQ, DQQQQDQ, |
| DQQQQQD, QDDQQQQ, QDQDQQQ, QDQQDQQ, QDQQQDQ, QDQQQQD, |
| QQDDQQQ, QQDQDQQ, QQDQQDQ, QQDQQQD, QQQDDQQ, QQQDQDQ, |
| QQQDQQD, QQQQDDQ, QQQQDQD QQQQQQD, DQQQQQQ, QDQQQQQ, |
| QQDQQQQ, QQQDQQQ, QQQQDQQ, and QQQQQDQ. |

TABLE 4

| | | | | | |
|---|---|---|---|---|---|
| | | | | | (SEQ ID NO: 2450) |
| 10 | 20 | 30 | 40 | 50 | 60 |
| MFLQNLFLGF | LAVVCANATP | LGPASSLPQS | FLLKCLEQVR | KIQGDGAALQ | EKLCATYKLC |
| 70 | 60 | 90 | 100 | 110 | 120 |
| HPEELVLLGH | SLGIPWAPLS | SCPSQALQLA | GCLSQLHSGL | FLYQGLLQAL | EGISPELGPT |
| 130 | 140 | 150 | 160 | 170 | 180 |
| LDTLQLDVAD | FATTIWQQME | ELGMAPALQP | TQGAMPAFAS | AFQRRAGGVL | VASHLQSFLE |
| 190 | 200 | 210 | 220 | 230 | 240 |
| VSYRVLRHLA | QPNNTNNTNN | TNNTNNTNNT | NNTNNTNNTN | NTNNTNNTNN | TNNTNNTNNT |
| 250 | 260 | 270 | 280 | 290 | 300 |
| NNTNNTNNTN | NTNNTNNTNN | TNNTNNTNNT | NNTNNTNNTN | NTNNTNNTNN | TNNTNNTNNT |
| 310 | 320 | 330 | 340 | 350 | 360 |
| NNTNNTNNTN | NTNNTNNTNN | TNNTNNTNNT | NNTNNTNNTN | NTNNTNN*\|.. | .......... |
| | | | | | (SEQ ID NO: 2451) |
| 10 | 20 | 30 | 40 | 50 | 60 |
| atgttcttgc | aaaatttatt | ccttggcttt | ttggccgttg | tttgcgcaaa | cgcgACTCCG |
| 70 | 80 | 90 | 100 | 110 | 120 |
| CTGGGTCCAG | CTAGCTCCCT | GCCCCAGAGC | TTCCTGCTCA | AGTGCTTAGA | GCAAGTGAGG |
| 130 | 140 | 150 | 160 | 170 | 180 |
| AAGATCCAGG | GCGATGGCGC | AGCGCTCCAG | GAGAAGCTGT | GTGCCACCTA | CAAGCTGTGC |
| 190 | 200 | 210 | 220 | 230 | 240 |
| CACCCCGAGG | AGCTGGTGCT | GCTCGGACAC | TCTCTGGGCA | TCCCCTGGGC | TCCCCTGAGC |
| 250 | 260 | 270 | 280 | 290 | 300 |
| AGCTGCCCCA | GCCAGGCCCT | GCAGCTGGCA | GGCTGCTTGA | GCCAACTCCA | TAGCGGCCTT |
| 310 | 320 | 330 | 340 | 350 | 360 |
| TTCCTCTACC | AGGGGCTCCT | GCAGGCCCTG | GAAGGGATCT | CCCCCGAGTT | GGGTCCCACC |
| 370 | 380 | 390 | 400 | 410 | 420 |
| TTGGACACAC | TGCAGCTGGA | CGTCGCCGAC | TTTGCCACCA | CCATCTGGCA | GCAGATGGAA |

TABLE 4-continued

| | | | | | |
|---|---|---|---|---|---|
| 430 | 440 | 450 | 460 | 470 | 480 |
| GAACTGGGAA | TGGCCCCTGC | CCTGCAGCCG | ACCCAGGGTG | CCATGCCGGC | CTTCGCCTCT |
| 490 | 500 | 510 | 520 | 530 | 540 |
| GCTTTCCAGC | GCCGGGCAGG | AGGGGTCCTA | GTTGCCTCCC | ATCTGCAGAG | CTTCCTGGAG |
| 550 | 560 | 570 | 580 | 590 | 600 |
| GTGTCGTACC | GCGTTCTACG | CCACCTTGCC | CAGCCTAACA | ACACCAACAA | TACCAACAAT |
| 610 | 620 | 630 | 640 | 650 | 660 |
| ACAAACAACA | CCAACAATAC | CAACAATACA | AACAACACCA | ACAATACCAA | CAATACAAAC |
| 670 | 680 | 690 | 700 | 710 | 720 |
| AACACCAACA | ATACCAACAA | TACAAACAAC | ACCAACAATA | CCAACAATAC | AAACAACACC |
| 730 | 740 | 750 | 760 | 770 | 780 |
| AACAATACCA | ACAATACAAA | CAACACCAAC | AATACCAACA | ATACAAACAA | CACCAATAAT |
| 790 | 800 | 810 | 820 | 830 | 840 |
| ACCAACAATA | CAAACAACAC | CAATAATACC | AACAATACAA | ACAACACCAA | TAATACCAAC |
| 850 | 860 | 870 | 880 | 890 | 900 |
| AATACAAACA | ACACCAATAA | TACCAACAAT | ACAAACAACA | CCAATAATAC | CAACAATACA |
| 910 | 920 | 930 | 940 | 950 | 960 |
| AACAACACCA | ATAATACCAA | CAATACAAAC | AACACCAATA | ATACCAACAA | TACAAACAAC |
| 970 | 980 | 990 | 1000 | 1010 | 1020 |
| ACCAATAATA | CCAACAATAC | AAACAACACC | AATAATACCA | ACAATACAAA | CAACACCAAT |
| 1030 | 1040 | 1050 | 1060 | 1070 | 1080 |
| AATACCAACA | ATACAAACAA | CTAG...... | .......... | .......... | .......... |

TABLE 5

EPO
*Homo sapiens* erythropoietin (EPO), mRNA.
ACCESSION NM_000799
VERSION NM_000799.2 GI: 62240996

(SEQ ID NO: 2452)

MGVHECPAWLWLLLSLLSLPLGLPVLGAPPRLICDSRVLERYLLEAKEAENITTGCAEHCSLNENITVPDTKVNF

YAWKRMEVGQQAVEVWQGLALLSEAVLRGQALLVNSSQPWEPLQLHVDKAVSGLRSLTTLLRALGAQKEAISPPD

AASAAPLRTITADTFRKLFRVYSNFLRGKLKLYTGEACRTGDR (SEQ ID NO: 2453)

1 cccggagccg gaccggggcc accgcgcccg ctctgctccg acaccgcgcc ccctggacag 61 ccgccctctc ctccaggccc gtggggctgg ccctgcaccg ccgagcttcc cgggatgagg 121 gcccccggtg tggtcacccg gcgcgcccca ggtcgctgag ggaccccggc caggcgcgga 181 gatgggggtg cacgaatgtc ctgcctggct gtggcttctc ctgtccctgc tgtcgctccc 241 tctgggcctc ccagtcctgg gcgccccacc acgcctcatc tgtgacagcc gagtcctgga 301 gaggtacctc ttggaggcca aggaggccga gaatatcacg acgggctgtg ctgaacactg 361 cagcttgaat gagaatatca ctgtcccaga caccaaagtt aatttctatg cctggaagag 421 gatggaggtc gggcagcagg ccgtagaagt ctggcagggc ctggccctgc tgtcggaagc 481 tgtcctgcgg ggccaggccc tgttggtcaa ctcttcccag ccgtgggagc ccctgcagct 541 gcatgtggat aaagccgtca gtggccttcg cagcctcacc actctgcttc gggctctggg 601 agcccagaag gaagccatct cccctccaga tgcggcctca gctgctccac tccgaacaat 661 cactgctgac actttccgca aactcttccg agtctactcc aatttcctcc ggggaaagct 721 gaagctgtac acaggggagg cctgcaggac aggggacaga tgaccaggtg tgtccacctg 781 ggcatatcca ccacctccct caccaacatt gcttgtgcca caccctcccc cgccactcct 841 gaaccccgtc gaggggctct cagctcagcg ccagcctgtc ccatggacac tccagtgcca TABLE 5-continued

```
 901 gcaatgacat ctcaggggcc agaggaactg tccagagagc aactctgaga tctaaggatg

 961 tcacagggcc aacttgaggg cccagagcag gaagcattca gagagcagct ttaaactcag

1021 ggacagagcc atgctgggaa gacgcctgag ctcactcggc accctgcaaa atttgatgcc

1081 aggacacgct ttggaggcga tttacctgtt ttcgcaccta ccatcaggga caggatgacc

1141 tggagaactt aggtggcaag ctgtgacttc tccaggtctc acgggcatgg gcactccctt

1201 ggtggcaaga gccccttga caccggggtg gtgggaacca tgaagacagg atgggggctg

1261 gcctctggct ctcatggggt ccaagttttg tgtattcttc aacctcattg acaagaactg

1321 aaaccaccaa aaaaaaaaaa
```

MCSF
*Homo sapiens* colony stimulating factor 1 (macrophage)
(CSF1), transcript variant 4, mRNA.
ACCESSION NM_172212
VERSION NM_172212.1 GI: 27262666

(SEQ ID NO: 2454)

```
MTAPGAAGRCPPTTWLGSLLLLVCLLASRSITEEVSEYCSHMIGSGHLQSLQRLIDSQMETSCQITFEFVDQEQL

KDPVCYLKKAFLLVQDIMEDTMRFRDNTPNAIAIVQLQELSLRLKSCFTKDYEEHDKACVRTFYETPLQLLEKVK

NVFNETKNLLDKDWNIFSKNCNNSFAECSSQDVVTKPDCNCLYPKAIPSSDPASVSPHQPLAPSMAPVAGLTWED

SEGTEGSSLLPGEQPLHTVDPGSAKQRPPRSTCQSFEPPETPVVKDSTIGGSPQPRPSVGAFNPGMEDILDSAMG

TNWVPEEASGEASEIPVPQGTELSPSRPGGGSMQTEPARPSNFLSASSPLPASAKGQQPADVTGTALPRVGPVRP

TGQDWNHTPQKTDHPSALLRDPPEPGSPRISSLRPQGLSNPSTLSAQPQLSRSHSSGSVLPLGELEGRRSTRDRR

SPAEPEGGPASEGAARPLPRFNSVPLTDTGHERQSEGSSSPQLQESVFHLLVPSVILVLLAVGGLLFYRWRRRSH

QRADSPLEQPEGSPLTQDDRQVELPVQEP
```

(SEQ ID NO: 2455)

```
   1 gagggctggc cagtgaggct cggcccgggg aaagtgaaag tttgcctggg tcctctcggc

  61 gccagagccg ctctccgcat cccaggacag cggtgcggcc ctcggccggg gcgcccactc

 121 cgcagcagcc agcgagcgag cgagcgagcg agggcggccg acgcgcccgg ccgggaccca

 181 gctgcccgta tgaccgcgcc gggcgccgcc gggcgctgcc ctcccacgac atggctgggc

 241 tccctgctgt tgttggtctg tctcctggcg agcaggagta tcaccgagga ggtgtcggag

 301 tactgtagcc acatgattgg gagtggacac ctgcagtctc tgcagcggct gattgacagt

 361 cagatggaga cctcgtgcca aattacattt gagtttgtag accaggaaca gttgaaagat

 421 ccagtgtgct accttaagaa ggcatttctc ctggtacaag acataatgga ggacaccatg

 481 cgcttcagag ataacacccc caatgccatc gccattgtgc agctgcagga actctctttg

 541 aggctgaaga gctgcttcac caaggattat gaagagcatg acaaggcctg cgtccgaact

 601 ttctatgaga cacctctcca gttgctggag aaggtcaaga atgtctttaa tgaaacaaag

 661 aatctccttg acaaggactg gaatattttc agcaagaact gcaacaacag ctttgctgaa

 721 tgctccagcc aagatgtggt gaccaagcct gattgcaact gcctgtaccc caaagccatc

 781 cctagcagtg acccggcctc tgtctcccct catcagcccc tcgccccctc catggcccct

 841 gtggctggct tgacctggga ggactctgag ggaactgagg gcagctccct cttgcctggt

 901 gagcagcccc tgcacacagt ggatccaggc agtgccaagc agcggccacc caggagcacc

 961 tgccagagct ttgagccgcc agagacccca gttgtcaagg acagcaccat cggtggctca

1021 ccacagcctc gcccctctgt cggggccttc aaccccggga tggaggatat tcttgactct

1081 gcaatgggca ctaattgggt cccagaagaa gcctctggag aggccagtga gattcccgta

1141 ccccaaggga cagagctttc cccctccagg ccaggagggg gcagcatgca gacagagccc

1201 gccagaccca gcaacttcct ctcagcatct tctccactcc ctgcatcagc aaagggccaa
```

TABLE 5-continued

```
1261 cagccggcag atgtaactgg tacagccttg cccagggtgg gccccgtgag gcccactggc
1321 caggactgga atcacacccc ccagaagaca gaccatccat ctgccctgct cagagacccc
1381 ccggagccag gctctcccag gatctcatca ctgcgccccc agggcctcag caacccctcc
1441 accctctctg ctcagccaca gctttccaga agccactcct cgggcagcgt gctgcccctt
1501 ggggagctgg agggcaggag gagcaccagg gatcggagga gccccgcaga gccagaagga
1561 ggaccagcaa gtgaaggggc agccaggccc ctgccccgtt ttaactccgt tcctttgact
1621 gacacaggcc atgagaggca gtccgaggga tcctccagcc cgcagctcca ggagtctgtc
1681 ttccacctgc tggtgcccag tgtcatcctg gtcttgctgg ccgtcggagg cctcttgttc
1741 tacaggtgga ggcggcggag ccatcaagag cctcagagag cggattctcc cttggagcaa
1801 ccagagggca gcccccctgac tcaggatgac agacaggtgg aactgccagt gtagagggaa
1861 ttctaagacc cctcaccatc ctggacacac tcgtttgtca atgtccctct gaaaatgtga
1921 cgcccagccc cggacacagt actccagatg ttgtctgacc agctcagaga gagtacagtg
1981 ggactgttac cttccttgat atggacagta ttcttctatt tgtgcagatt aagattgcat
2041 tagttttttt cttaacaact gcatcatact gttgtcatat gttgagcctg tggttctata
2101 aaacccctag ttccatttcc cataaacttc tgtcaagcca gaccatctct accctgtact
2161 tggacaactt aactttttta accaaagtgc agtttatgtt cacctttgtt aaagccacct
2221 ttgtggtttc tgcccatcac ctgaacctac tgaagttgtg tgaaatccta attctgtcat
2281 ctccgtagcc ctcccagttg tgcctcctgc acattgatga gtgcctgctg ttgtctttgc
2341 ccatgttgtt gatgtagctg tgaccctatt gttcctcacc cctgcccccc gccaacccca
2401 gctggcccac ctcttccccc tcccacccaa gcccacagcc agcccatcag gaagccttcc
2461 tggcttctcc acaaccttct gactgtcttt tcagtcatgc cccctgctct tttgtatttg
2521 gctaatagta tatcaatttg cactt
```

*Homo sapiens* colony stimulating factor 1 (macrophage)
(CSF1), transcript variant 3, mRNA.
ACCESSION NM_172211
VERSION NM_172211.1 GI: 27262664

(SEQ ID NO: 2456)

```
MTAPGAAGRCPPTTWLGSLLLLVCLLASRSITEEVSEYCSHMIGSGHLQSLQRLIDSQMETSCQITFEFVDQEQL
KDPVCYLKKAFLLVQDIMEDTMRFRDNTPNAIAIVQLQELSLRLKSCFTKDYEEHDKACVRTFYETPLQLLEKVK
NVFNETKNLLDKDWNIFSKNCNNSFAECSSQGHERQSEGSSSPQLQESVFHLLVPSVILVLLAVGGLLFYRWRRR
SHQEPQRADSPLEQPEGSPLTQDDRQVELPV
```

(SEQ ID NO: 2457)

```
  1 gagggctggc cagtgaggct cggcccgggg aaagtgaaag tttgcctggg tcctctcggc
 61 gccagagccg ctctccgcat cccaggacag cggtgcggcc ctcggccggg gcgcccactc
121 cgcagcagcc agcgagcgag cgagcgagcg agggcggccg acgcgcccgg ccgggaccca
181 gctgcccgta tgaccgcgcc gggcgccgcc gggcgctgcc ctcccacgac atggctgggc
241 tccctgctgt tgttggtctg tctcctggcg agcaggagta tcaccgagga ggtgtcggag
301 tactgtagcc acatgattgg gagtggacac ctgcagtctc tgcagcggct gattgacagt
361 cagatggaga cctcgtgcca aattacattt gagtttgtag accaggaaca gttgaaagat
421 ccagtgtgct accttaagaa ggcatttctc ctggtacaag acataatgga ggacaccatg
481 cgcttcagag ataacacccc caatgccatc gccattgtgc agctgcagga actctctttg
541 aggctgaaga gctgcttcac caaggattat gaagagcatg acaaggcctg cgtccgaact
601 ttctatgaga cacctctcca gttgctggag aaggtcaaga atgtctttaa tgaaacaaag
```

TABLE 5-continued

```
 661 aatctccttg acaaggactg gaatattttc agcaagaact gcaacaacag ctttgctgaa
 721 tgctccagcc aaggccatga gaggcagtcc gagggatcct ccagcccgca gctccaggag
 781 tctgtcttcc acctgctggt gcccagtgtc atcctggtct tgctggccgt cggaggcctc
 841 ttgttctaca ggtggaggcg gcggagccat caagagcctc agagagcgga ttctcccttg
 901 gagcaaccag agggcagccc cctgactcag gatgacagac aggtggaact gccagtgtag
 961 agggaattct aagctggacg cacagaacag tctctccgtg ggaggagaca ttatggggcg
1021 tccaccacca cccctccctg gccatcctcc tggaatgtgg tctgccctcc accagagctc
1081 ctgcctgcca ggactggacc agagcagcca ggctggggcc cctctgtctc aacccgcaga
1141 cccttgactg aatgagagag gccagaggat gctccccatg ctgccactat ttattgtgag
1201 ccctggaggc tcccatgtgc ttgaggaagg ctggtgagcc cggctcagga ccctcttccc
1261 tcaggggctg caccctcctc tcactccctt ccatgccgga acccaggcca gggacccacc
1321 ggcctgtggt ttgtgggaaa gcagggtgga cgctgaggag tgaaagaacc ctgcacccag
1381 agggcctgcc tggtgccaag gtatcccagc ctggacaggc atggacctgt ctccagagag
1441 aggagcctga agttcgtggg gcgggacagc gtcggcctga tttcccgtaa aggtgtgcag
1501 cctgagagac gggaagagga ggcctctgga cctgctggtc tgcactgaca gcctgaaggg
1561 tctacaccct cggctcacct aagtgccctg tgctggttgc caggcgcaga ggggaggcca
1621 gccctgccct caggacctgc ctgacctgcc agtgatgcca agaggggat caagcactgg
1681 cctctgcccc tcctccttcc agcacctgcc agagcttctc caggaggcca agcagaggct
1741 cccctcatga aggaagccat tgcactgtga acactgtacc tgcctgctga acagcctgcc
1801 cccgtccatc catgagccag catccgtccg tcctccactc tccagcctct cccca
```

*Homo sapiens* colony stimulating factor 1 (macrophage)
(CSF1), transcript variant 2, mRNA.
ACCESSION NM_172210
VERSION NM_172210.1 GI: 27262662

(SEQ ID NO: 2458)

```
MTAPGAAGRCPPTTWLGSLLLLVCLLASRSITEEVSEYCSHMIGSGHLQSLQRLIDSQMETSCQITFEFVDQEQL
KDPVCYLKKAFLLVQDIMEDTMRFRDNTPNAIAIVQLQELSLRLKSCFTKDYEEHDKACVRTFYETPLQLLEKVK
NVFNETKNLLDKDWNIFSKNCNNSFAECSSQDVVTKPDCNCLYPKAIPSSDPASVSPHQPLAPSMAPVAGLTWED
SEGTEGSSLLPGEQPLHTVDPGSAKQRPPRSTCQSFEPPETPVVKDSTIGGSPQPRPSVGAFNPGMEDILDSAMG
TNWVPEEASGEASEIPVPQGTELSPSRPGGGSMQTEPARPSNFLSASSPLPASAKGQQPADVTGHERQSEGSSSP
QLQESVFHLLVPSVILVLLAVGGLLFYRWRRRSHQEPQRADSPLEQPEGSPLTQDDRQVELPV
```

(SEQ ID NO: 2459)

```
   1 gagggctggc cagtgaggct cggcccgggg aaagtgaaag tttgcctggg tcctctcggc
  61 gccagagccg ctctccgcat cccaggacag cggtgcggcc ctcggccggg gcgcccactc
 121 cgcagcagcc agcgagcgag cgagcgagcg agggcggccg acgcgcccgg ccgggaccca
 181 gctgcccgta tgaccgcgcc gggcgccgcc gggcgctgcc ctcccacgac atggctgggc
 241 tccctgctgt tgttggtctg tctcctggcg agcaggagta tcaccgagga ggtgtcggag
 301 tactgtagcc acatgattgg gagtggacac ctgcagtctc tgcagcggct gattgacagt
 361 cagatggaga cctcgtgcca aattacattt gagtttgtag accaggaaca gttgaaagat
 421 ccagtgtgct accttaagaa ggcatttctc ctggtacaag acataatgga ggacaccatg
 481 cgcttcagag ataacacccc caatgccatc gccattgtgc agctgcagga actctctttg
 541 aggctgaaga gctgcttcac caaggattat gaagagcatg acaaggcctg cgtccgaact
 601 ttctatgaga cacctctcca gttgctggag aaggtcaaga atgtctttaa tgaaacaaag
```

TABLE 5-continued

```
 661 aatctccttg acaaggactg gaatattttc agcaagaact gcaacaacag ctttgctgaa
 721 tgctccagcc aagatgtggt gaccaagcct gattgcaact gcctgtaccc caaagccatc
 781 cctagcagtg acccggcctc tgtctcccct catcagcccc tcgcccccct catggcccct
 841 gtggctggct tgacctggga ggactctgag ggaactgagg gcagctccct cttgcctggt
 901 gagcagcccc tgcacacagt ggatccaggc agtgccaagc agcggccacc caggagcacc
 961 tgccagagct ttgagccgcc agagacccca gttgtcaagg acagcaccat cggtggctca
1021 ccacagcctc gcccctctgt cggggccttc aaccccggga tggaggatat tcttgactct
1081 gcaatgggca ctaattgggt cccagaagaa gcctctggag aggccagtga gattcccgta
1141 ccccaaggga cagagctttc cccctccagg ccaggagggg gcagcatgca gacagagccc
1201 gccagaccca gcaacttcct ctcagcatct tctccactcc ctgcatcagc aaagggccaa
1261 cagccggcag atgtaactgg ccatgagagg cagtccgagg gatcctccag cccgcagctc
1321 caggagtctg tcttccacct gctggtgccc agtgtcatcc tggtcttgct ggccgtcgga
1381 ggcctcttgt tctacaggtg gaggcggcgg agccatcaag agcctcagag agcggattct
1441 cccttggagc aaccagaggg cagcccccctg actcaggatg acagacaggt ggaactgcca
1501 gtgtagaggg aattctaag
```

*Homo sapiens* colony stimulating factor 1 (macrophage)
(CSF1), transcript variant 1, mRNA.
ACCESSION NM_000757
VERSION NM_000757.3 GI: 27262660

(SEQ ID NO: 2460)

```
MTAPGAAGRCPPTTWLGSLLLLVCLLASRSITEEVSEYCSHMIGSGHLQSLQRLIDSQMETSCQITFEFVDQEQL
KDPVCYLKKAFLLVQDIMEDTMRFRDNTPNAIAIVQLQELSLRLKSCFTKDYEEHDKACVRTFYETPLQLLEKVK
NFVFNETKNLLDKDWNIFSKNCNNSFAECSSQDVVTKPDCNCLYPKAIPSSDPASVSPHQPLAPSMAPVAGLTWE
DSEGTEGSSLLPGEQPLHTVDPGSAKQRPPRSTCQSFEPPETPVVKDSTIGGSPQPRPSVGAFNPGMEDILDSAM
GTNWVPEEASGEASEIPVPQGTELSPSRPGGGSMQTEPARPSNFLSASSPLPASAKGQQPADVTGTALPRVGPVR
PTGQDWNHTPQKTDHPSALLRDPPEPGSPRISSLRPQGLSNPSTLSAQPQLSRSHSSGSVLPLGELEGRRSTRDR
RSPAEPEGGPASEGAARPLPRFNSVPLTDTGHERQSEGSSSPQLQESVFHLLVPSVILVLLAVGGLLFYRWRRRS
HQEPQRADSPLEQPEGSPLTQDDRQVELPV
```

(SEQ ID NO: 2461)

```
   1 gagggctggc cagtgaggct cggcccgggg aaagtgaaag tttgcctggg tcctctcggc
  61 gccagagccg ctctccgcat cccaggacag cggtgcggcc ctcggccggg gcgcccactc
 121 cgcagcagcc agcgagcgag cgagcgagcg agggcggccg acgcgcccgg ccgggaccca
 181 gctgcccgta tgaccgcgcc gggcgccgcc gggcgctgcc ctcccacgac atggctgggc
 241 tccctgctgt tgttggtctg tctcctggcg agcaggagta tcaccgagga ggtgtcggag
 301 tactgtagcc acatgattgg gagtggacac ctgcagtctc tgcagcggct gattgacagt
 361 cagatggaga cctcgtgcca aattacattt gagtttgtag accaggaaca gttgaaagat
 421 ccagtgtgct accttaagaa ggcatttctc ctggtacaag acataatgga ggacaccatg
 481 cgcttcagag ataacacccc caatgccatc gccattgtgc agctgcagga actctctttg
 541 aggctgaaga gctgcttcac caaggattat gaagagcatg acaaggcctg cgtccgaact
 601 ttctatgaga cacctctcca gttgctggag aaggtcaaga atgtctttaa tgaaacaaag
 661 aatctccttg acaaggactg gaatattttc agcaagaact gcaacaacag ctttgctgaa
 721 tgctccagcc aagatgtggt gaccaagcct gattgcaact gcctgtaccc caaagccatc
 781 cctagcagtg acccggcctc tgtctcccct catcagcccc tcgcccccct catggcccct
```

TABLE 5-continued

```
 841 gtggctggct tgacctggga ggactctgag ggaactgagg gcagctccct cttgcctggt
 901 gagcagcccc tgcacacagt ggatccaggc agtgccaagc agcggccacc caggagcacc
 961 tgccagagct ttgagccgcc agagacccca gttgtcaagg acagcaccat cggtggctca
1021 ccacagcctc gcccctctgt cggggccttc aaccccggga tggaggatat tcttgactct
1081 gcaatgggca ctaattgggt cccagaagaa gcctctggag aggccagtga gattcccgta
1141 ccccaaggga cagagctttc cccctccagg ccaggagggg gcagcatgca gacagagccc
1201 gccagaccca gcaacttcct ctcagcatct tctccactcc ctgcatcagc aaagggccaa
1261 cagccggcag atgtaactgg tacagccttg cccagggtgg gccccgtgag gcccactggc
1321 caggactgga atcacacccc ccagaagaca gaccatccat ctgccctgct cagagacccc
1381 ccggagccag gctctcccag gatctcatca ctgcgccccc agggcctcag caacccctcc
1441 accctctctg ctcagccaca gctttccaga agccactcct cgggcagcgt gctgcccctt
1501 ggggagctgg agggcaggag gagcaccagg gatcggagga gccccgcaga gccagaagga
1561 ggaccagcaa gtgaaggggc agccaggccc ctgccccgtt ttaactccgt tcctttgact
1621 gacacaggcc atgagaggca gtccgaggga tcctccagcc cgcagctcca ggagtctgtc
1681 ttccacctgc tggtgcccag tgtcatcctg gtcttgctgg ccgtcggagg cctcttgttc
1741 tacaggtgga ggcggcggag ccatcaagag cctcagagag cggattctcc cttggagcaa
1801 ccagagggca gcccccctgac tcaggatgac agacaggtgg aactgccagt gtagagggaa
1861 ttctaagctg gacgcacaga acagtctctc cgtgggagga gacattatgg ggcgtccacc
1921 accacccctc cctggccatc ctcctggaat gtggtctgcc ctccaccaga gctcctgcct
1981 gccaggactg gaccagagca gccaggctgg ggcccctctg tctcaacccg cagacccttg
2041 actgaatgag agaggccaga ggatgctccc catgctgcca ctatttattg tgagccctgg
2101 aggctcccat gtgcttgagg aaggctggtg agcccggctc aggaccctct tccctcaggg
2161 gctgcaccct cctctcactc ccttccatgc cggaacccag gccagggacc caccggcctg
2221 tggtttgtgg gaaagcaggg tggacgctga ggagtgaaag aaccctgcac ccagagggcc
2281 tgcctggtgc caaggtatcc cagcctggac aggcatggac ctgtctccag agagaggagc
2341 ctgaagttcg tggggcggga cagcgtcggc ctgatttccc gtaaaggtgt gcagcctgag
2401 agacgggaag aggaggcctc tggacctgct ggtctgcact gacagcctga agggtctaca
2461 ccctcggctc acctaagtgc cctgtgctgg ttgccaggcg cagaggggag gccagccctg
2521 ccctcaggac ctgcctgacc tgccagtgat gccaagaggg ggatcaagca ctggcctctg
2581 cccctcctcc ttccagcacc tgccagagct tctccaggag gccaagcaga ggctcccctc
2641 atgaaggaag ccattgcact gtgaacactg tacctgcctg ctgaacagcc tgcccccgtc
2701 catccatgag ccagcatccg tccgtcctcc actctccagc ctctcccca
```

GM-CSF
*Homo sapiens* colony stimulating factor 2 (granulocyte-macrophage) (CSF2), mRNA.
ACCESSION NM_000758
VERSION NM_000758.2 GI: 27437029

(SEQ ID NO: 2462)

```
MWLQSLLLLGTVACSISAPARSPSPSTQPWEHVNAIQEARRLLNLSRDTAAEMNETVEVISEMFDLQEPTCLQTR
LELYKQGLRGSLTKLKGPLTMMASHYKQHCPPTPETSCATQIITFESFKENLKDFLLVIPFDCWEPVQE
```

(SEQ ID NO: 2463)

```
  1acacagagag aaaggctaaa gttctctgga ggatgtggct gcagagcctg ctgctcttgg
 61gcactgtggc ctgcagcatc tctgcacccg cccgctcgcc cagccccagc acgcagccct
```

TABLE 5-continued

121gggagcatgt gaatgccatc caggaggccc ggcgtctcct gaacctgagt agagacactg

181ctgctgagat gaatgaaaca gtagaagtca tctcagaaat gtttgacctc caggagccga

241cctgcctaca gacccgcctg gagctgtaca agcagggcct gcggggcagc ctcaccaagc

301tcaagggccc cttgaccatg atggccagcc actacaagca gcactgccct ccaaccccgg

361aaacttcctg tgcaacccag attatcacct ttgaaagttt caaagagaac ctgaaggact

421ttctgcttgt catccccttt gactgctggg agccagtcca ggagtgagac cggccagatg

481aggctggcca agccggggag ctgctctctc atgaaacaag agctagaaac tcaggatggt

541catcttggag ggaccaaggg gtgggccaca gccatggtgg gagtggcctg gacctgccct

601gggccacact gaccctgata caggcatggc agaagaatgg gaatatttta tactgacaga

661aatcagtaat atttatatat ttatattttt aaaatattta tttatttatt tatttaagtt

721catattccat atttattcaa gatgttttac cgtaataatt attattaaaa atatgcttct

781a

TNF-ALPHA TYPE II RECEPTOR
*Homo sapiens* tumor necrosis factor (TNF superfamily, member 2) (TNF), mRNA.
ACCESSION NM_000594
VERSION NM_000594.2 GI: 25952110

(SEQ ID NO: 2464)

MSTESMIRDVELAEEALPKKTGGPQGSRRCLFLSLFSFLIVAGATTLFCLLHFGVIGPQREEFPRDLSLISPLAQ

AVRSSSRTPSDKPVAHVVANPQAEGQLQWLNRRANALLANGVELRDNQLVVPSEGLYLIYSQVLFKGQGCPSTHV

LLTHTISRIAVSYQTKVNLLSAIKSPCQRETPEGAEAKPWYEPIYLGGVFQLEKGDRLSAEINRPDYLDFAESGQ

VYFGIIAL (SEQ ID NO: 2465)

1 ctccctcagc aaggacagca gaggaccagc taagagggag agaagcaact acagaccccc 61 cctgaaaaca accctcagac gccacatccc ctgacaagct gccaggcagg ttctcttcct 121 ctcacatact gacccacggc tccaccctct ctcccctgga aaggacacca tgagcactga 181 aagcatgatc cgggacgtgg agctggccga ggaggcgctc cccaagaaga caggggggcc 241 ccagggctcc aggcggtgct tgttcctcag cctcttctcc ttcctgatcg tggcaggcgc 301 caccacgctc ttctgcctgc tgcactttgg agtgatcggc ccccagaggg aagagttccc 361 cagggacctc tctctaatca gccctctggc ccaggcagtc agatcatctt ctcgaacccc 421 gagtgacaag cctgtagccc atgttgtagc aaaccctcaa gctgaggggc agctccagtg 481 gctgaaccgc cgggccaatg ccctcctggc caatggcgtg gagctgagag ataaccagct 541 ggtggtgcca tcagagggcc tgtacctcat ctactcccag gtcctcttca agggccaagg 601 ctgcccctcc acccatgtgc tcctcaccca caccatcagc cgcatcgccg tctcctacca 661 gaccaaggtc aacctcctct ctgccatcaa gagcccctgc cagagggaga ccccagaggg 721 ggctgaggcc aagccctggt atgagcccat ctatctggga ggggtcttcc agctggagaa 781 gggtgaccga ctcagcgctg agatcaatcg gcccgactat ctcgactttg ccgagtctgg 841 gcaggtctac tttgggatca ttgccctgtg aggaggacga acatccaacc ttcccaaacg 901 cctcccctgc cccaatccct ttattacccc ctccttcaga caccctcaac ctcttctggc 961 tcaaaaagag aattgggggc ttagggtcgg aacccaagct tagaacttta agcaacaaga 1021 ccaccacttc gaaacctggg attcaggaat gtgtggcctg cacagtgaag tgctggcaac 1081 cactaagaat tcaaactggg gcctccagaa ctcactgggg cctacagctt tgatccctga 1141 catctggaat ctggagacca gggagccttt ggttctggcc agaatgctgc aggacttgag 1201 aagacctcac ctagaaattg acacaagtgg accttaggcc ttcctctctc cagatgtttc TABLE 5-continued

```
1261 cagacttcct tgagacacgg agcccagccc tccccatgga gccagctccc tctatttatg
1321 tttgcacttg tgattattta ttatttattt attatttatt tatttacaga tgaatgtatt
1381 tatttgggag accggggtat cctgggggac ccaatgtagg agctgccttg gctcagacat
1441 gttttccgtg aaaacggagc tgaacaatag gctgttccca tgtagccccc tggcctctgt
1501 gccttctttt gattatgttt tttaaaatat ttatctgatt aagttgtcta aacaatgctg
1561 atttggtgac caactgtcac tcattgctga gcctctgctc cccaggggag ttgtgtctgt
1621 aatcgcccta ctattcagtg gcgagaaata aagtttgctt agaaaagaa
```

DEFINITION *Homo sapiens* tumor necrosis factor receptor superfamily, member 1A (TNFRSF1A), mRNA.
ACCESSION NM_001065
VERSION NM_001065.2 GI: 23312372

(SEQ ID NO: 2466)

```
MGLSTVPDLLLPLVLLELLVGIYPSGVIGLVPHLGDREKRDSVCPQGKYIHPQNNSICCTKCHKGTYLY
NDCPGPGQDTDCRECESGSFTASENHLRHCLSCSKCRKEMGQVEISSCTVDRDTVCGCRKNQYRHYWSENLFQCF
NCSLCLNGTVHLSCQEKQNTVCTCHAGFFLRENECVSCSNCKKSLECTKLCLPQIENVKGTEDSGTTVLLPLVIF
FGLCLLSLLFIGLMYRYQRWKSKLYSIVCGKSTPEKEGELEGTTTKPLAPNPSFSPTPGFTPTLGFSPVPSSTFT
SSSTYTPGDCPNFAAPRREVAPPYQGADPILATALASDPIPNPLQKWEDSAHKPQSLDTDDPATLYAVVENVPPL
RWKEFVRRLGLSDHEIDRLELQNGRCLREAQYSMLATWRRRTPRREATLELLGRVLRDMDLLGCLEDIEEALCGP
AALPPAPSLLR
```

(SEQ ID NO: 2467)

```
   1 gctgttgcaa cactgcctca ctcttcccct cccaccttct ctcccctcct ctctgcttta
  61 atttctcag aattctctgg actgaggctc cagttctggc ctttggggtt caagatcact
 121 gggaccaggc cgtgatctct atgcccgagt ctcaaccctc aactgtcacc ccaaggcact
 181 tgggacgtcc tggacagacc gagtcccggg aagccccagc actgccgctg ccacactgcc
 241 ctgagcccaa atgggggagt gagaggccat agctgtctgg catgggcctc tccaccgtgc
 301 ctgacctgct gctgccactg gtgctcctgg agctgttggt gggaatatac ccctcagggg
 361 ttattggact ggtccctcac ctaggggaca gggagaagag agatagtgtg tgtccccaag
 421 gaaaatatat ccaccctcaa aataattcga tttgctgtac caagtgccac aaaggaacct
 481 acttgtacaa tgactgtcca ggcccggggc aggatacgga ctgcagggag tgtgagagcg
 541 gctccttcac cgcttcagaa aaccacctca gacactgcct cagctgctcc aaatgccgaa
 601 aggaaatggg tcaggtggag atctcttctt gcacagtgga ccgggacacc gtgtgtggct
 661 gcaggaagaa ccagtaccgg cattattgga gtgaaaacct tttccagtgc ttcaattgca
 721 gcctctgcct caatgggacc gtgcacctct cctgccagga gaaacagaac accgtgtgca
 781 cctgccatgc aggtttcttt ctaagagaaa acgagtgtgt ctcctgtagt aactgtaaga
 841 aaagcctgga gtgcacgaag ttgtgcctac cccagattga gaatgttaag ggcactgagg
 901 actcaggcac cacagtgctg ttgcccctgg tcattttctt tggtctttgc cttttatccc
 961 tcctcttcat tggtttaatg tatcgctacc aacggtggaa gtccaagctc tactccattg
1021 tttgtgggaa atcgacacct gaaaaagagg gggagcttga aggaactact actaagcccc
1081 tggccccaaa cccaagcttc agtcccactc caggcttcac ccccaccctg ggcttcagtc
1141 ccgtgcccag ttccaccttc acctccagct ccacctatac ccccggtgac tgtcccaact
1201 ttgcggctcc ccgcagagag gtggcaccac cctatcaggg ggctgacccc atccttgcga
1261 cagccctcgc ctccgacccc atccccaacc cccttcagaa gtgggaggac agcgcccaca
1321 agccacagag cctagacact gatgaccccg cgacgctgta cgccgtggtg gagaacgtgc
```

TABLE 5-continued 1381 ccccgttgcg ctggaaggaa ttcgtgcggc gcctagggct gagcgaccac gagatcgatc 1441 ggctggagct gcagaacggg cgctgcctgc gcgaggcgca atacagcatg ctggcgacct 1501 ggaggcggcg cacgccgcgg cgcgaggcca cgctggagct gctgggacgc gtgctccgcg 1561 acatggacct gctgggctgc ctggaggaca tcgaggaggc gctttgcggc cccgccgccc 1621 tcccgcccgc gcccagtctt ctcagatgag gctgcgcccc tgcgggcagc tctaaggacc 1681 gtcctgcgag atcgccttcc aaccccactt ttttctggaa aggaggggtc ctgcaggggc 1741 aagcaggagc tagcagccgc ctacttggtg ctaacccctc gatgtacata gcttttctca 1801 gctgcctgcg cgccgccgac agtcagcgct gtgcgcgcgg agagaggtgc gccgtgggct 1861 caagagcctg agtgggtggt ttgcgaggat gagggacgct atgcctcatg cccgttttgg 1921 gtgtcctcac cagcaaggct gctcgggggc ccctggttcg tccctgagcc tttttcacag 1981 tgcataagca gtttttttttg tttttgtttt gttttgtttt gtttttaaat caatcatgtt 2041 acactaatag aaacttggca ctcctgtgcc ctctgcctgg acaagcacat agcaagctga 2101 actgtcctaa ggcaggggcg agcacggaac aatggggcct tcagctggag ctgtggactt 2161 ttgtacatac actaaaattc tgaagttaaa gctctgctct tggaaaaaaa aaaaaaaaaa 2221 aaaaaaaaaa aaaaaa BETA INTERFERON
*Homo sapiens* interferon, beta 1, fibroblast (IFNB1), mRNA.
ACCESSION NM_002176
VERSION NM_002176.2 GI: 50593016

(SEQ ID NO: 2468)
MTNKCLLQIALLLCFSTTALSMSYNLLGFLQRSSNFQCQKLLWQLNGRLEYCLKDRMNFDIPEEIKQLQQFQKED

AALTIYEMLQNIFAIFRQDSSSTGWNETIVENLLANVYHQINHLKTVLEEKLEKEDFTRGKLMSSLHLKRYYGRI

LHYLKAKEYSHCAWTIVRVEILRNFYFINRLTGYLRN (SEQ ID NO: 2469)
1acattctaac tgcaaccttt cgaagccttt gctctggcac aacaggtagt aggcgacact 61gttcgtgttg tcaacatgac caacaagtgt ctcctccaaa ttgctctcct gttgtgcttc 121tccactacag ctctttccat gagctacaac ttgcttggat tcctacaaag aagcagcaat 181tttcagtgtc agaagctcct gtggcaattg aatgggaggc ttgaatactg cctcaaggac 241aggatgaact ttgacatccc tgaggagatt aagcagctgc agcagttcca gaaggaggac 301gccgcattga ccatctatga gatgctccag aacatctttg ctattttcag acaagattca 361tctagcactg gctggaatga gactattgtt gagaacctcc tggctaatgt ctatcatcag 421ataaaccatc tgaagacagt cctggaagaa aaactggaga aagaagattt caccaggggaa 481aaactcatga gcagtctgca cctgaaaaga tattatggga ggattctgca ttacctgaag 541gccaaggagt acagtcactg tgcctggacc atagtcagag tggaaatcct aaggaacttt 601tacttcatta acagacttac aggttacctc cgaaactgaa gatctcctag cctgtgcctc 661tgggactgga caattgcttc aagcattctt caaccagcag atgctgttta agtgactgat 721ggctaatgta ctgcatatga aaggacacta gaagattttg aaatttttat taaattatga 781gttattttta tttatttaaa ttttattttg gaaaataaat tatttttggt gcaaaagtca TABLE 5-continued GAMMA INTERFERON
*Homo sapiens* interferon, gamma (IFNG), mRNA.
ACCESSION NM_000619
VERSION NM_000619.2 GI: 56786137

(SEQ ID NO: 2470)

MKYTSYILAFQLCIVLGSLGCYCQDPYVKEAENLKKYFNAGHSDVADNGTLFLGILKNWKEESDRKIMQSQIVSF

YFKLFKNFKDDQSIQKSVETIKEDMNVKFFNSNKKKRDDFEKLTNYSVTDLNVQRKAIHELIQVMAELSPAAKTG

KRKRSQMLFRGRRASQ (SEQ ID NO: 2471)

1 cacattgttc tgatcatctg aagatcagct attagaagag aaagatcagt taagtccttt 61 ggacctgatc agcttgatac aagaactact gatttcaact tctttggctt aattctctcg 121 gaaacgatga aatatacaag ttatatcttg gcttttcagc tctgcatcgt tttgggttct 181 cttggctgtt actgccagga cccatatgta aaagaagcag aaaaccttaa gaaatatttt 241 aatgcaggtc attcagatgt agcggataat ggaactcttt tcttaggcat tttgaagaat 301 tggaaagagg agagtgacag aaaaataatg cagagccaaa ttgtctcctt ttacttcaaa 361 ctttttaaaa actttaaaga tgaccagagc atccaaaaga gtgtggagac catcaaggaa 421 gacatgaatg tcaagttttt caatagcaac aaaaagaaac gagatgactt cgaaaagctg 481 actaattatt cggtaactga cttgaatgtc caacgcaaag caatacatga actcatccaa 541 gtgatggctg aactgtcgcc agcagctaaa acagggaagc gaaaaaggag tcagatgctg 601 tttcgaggtc gaagagcatc ccagtaatgg ttgtcctgcc tgcaatattt gaattttaaa 661 tctaaatcta tttattaata tttaacatta tttatatggg gaatatattt ttagactcat 721 caatcaaata agtatttata atagcaactt ttgtgtaatg aaaatgaata tctattaata 781 tatgtattat ttataattcc tatatcctgt gactgtctca cttaatcctt tgttttctga 841 ctaattaggc aaggctatgt gattacaagg ctttatctca ggggccaact aggcagccaa 901 cctaagcaag atcccatggg ttgtgtgttt atttcacttg atgatacaat gaacacttat 961 aagtgaagtg atactatcca gttactgccg gtttgaaaat atgcctgcaa tctgagccag 1021 tgctttaatg gcatgtcaga cagaacttga atgtgtcagg tgaccctgat gaaaacatag 1081 catctcagga gatttcatgc ctggtgcttc caaatattgt tgacaactgt gactgtaccc 1141 aaatggaaag taactcattt gttaaaatta tcaatatcta atatatatga ataaagtgta 1201 agttcacaac aaaaaaaaaa aaaaaaaaaa aaaaaaaaaa HUMAN GROWTH HORMONE
Human growth hormone (somatotropin, GH1) gene, complete cds.
ACCESSION J00148 K00612
VERSION J00148.1 GI: 183145

(SEQ ID NO: 2472)

MATGSRTSLLLAFGLLCLPWLQEGSAFPTIPLSRLFDNASLRAHRLHQLAFDTYQEFNPQTSLCFSESIPTPSNR

EETQQKSNLELLRISLLLIQSWLEPVQFLRSVFANSLVYGASDSNVYDLLKDLEEGIQTLMGRLEDGSPRTGQIF

KQTYSKFDTNSHNDDALLKNYGLLYCFRKDMDKVETFLRIVQCRSVEGSCGF (SEQ ID NO: 2473)

1 agggcaccca cgtgaccctt aaagagagga caagttgggt ggtattttct ggctgacact 61 ctgtgcacaa ccctcacaac actggttgac ggtgggaagg gaaagatgac aagccagggg 121 catgatccca gcatgtgtgg gaggagcttc taaattatcc attagcacaa gcccgtcagt 181 ggccccatgc ataaatgtac acagaaacag gtgggggcaa cagtgggaga gaaggggcca 241 gggtataaaa agggcccaca agagaccggc tcaaggatcc caaggcccaa ctccccgaac 301 cactcagggt cctgtggacg ctcacctagc tgcaatggct acaggtaagc gcccctaaaa 361 tccctttggg cacaatgtgt cctgagggga gaggcagcga cctgtagatg ggacgggggc TABLE 5-continued

| | |
|---|---|
| 421 | actaaccctc aggtttgggg cttctgaatg agtatcgcca tgtaagccca gtatggccaa |
| 481 | tctcagaaag ctcctggtcc ctggagggat ggagagagaa aaacaaacag ctcctggagc |
| 541 | agggagagtg ctggcctctt gctctccggc tccctctgtt gccctctggt ttctccccag |
| 601 | gctcccggac gtccctgctc ctggcttttg gcctgctctg cctgccctgg cttcaagagg |
| 661 | gcagtgcctt cccaaccatt cccttatcca ggctttttga caacgctagt ctccgcgccc |
| 721 | atcgtctgca ccagctggcc tttgacacct accaggagtt tgtaagctct tggggaatgg |
| 781 | gtgcgcatca ggggtggcag gaaggggtga ctttcccccg ctgggaaata agaggaggag |
| 841 | actaaggagc tcagggtttt tcccgaagcg aaaatgcagg cagatgagca cacgctgagt |
| 901 | gaggttccca gaaaagtaac aatgggagct ggtctccagc gtagaccttg gtgggcggtc |
| 961 | cttctcctag gaagaagcct atatcccaaa ggaacagaag tattcattcc tgcagaaccc |
| 1021 | ccagacctcc ctctgtttct cagagtctat tccgacaccc tccaacaggg aggaaacaca |
| 1081 | acagaaatcc gtgagtggat gccttgaccc caggcgggga tgggggagac ctgtagtcag |
| 1141 | agcccccggg cagcacaggc caatgcccgt ccttcccctg cagaacctag agctgctccg |
| 1201 | catctccctg ctgctcatcc agtcgtggct ggagcccgtg cagttcctca ggagtgtctt |
| 1261 | cgccaacagc ctggtgtacg gcgcctctga cagcaacgtc tatgacctcc taaaggacct |
| 1321 | agaggaaggc atccaaacgc tgatgggggt gggggtggcg ctaggggtcc ccaatcttgg |
| 1381 | agccccactg actttgagag ctgtgttaga gaaacactgc tgccctcttt ttagcagtcc |
| 1441 | aggccctgac ccaagagaac tcaccttatt cttcatttcc cctcgtgaat cctctagcct |
| 1501 | ttctctacac cctgaagggg agggaggaaa atgaatgaat gagaaaggga gggagcagta |
| 1561 | cccaagcgct tggcctctcc ttctcttcct tcactttgca gaggctggaa gatggcagcc |
| 1621 | cccggactgg gcagatcttc aagcagacct acagcaagtt cgacacaaac tcacacaacg |
| 1681 | atgacgcact actcaagaac tacgggctgc tctactgctt caggaaggac atggacaagg |
| 1741 | tcgagacatt cctgcgcatc gtgcagtgcc gctctgtgga gggcagctgt ggcttctagc |
| 1801 | tgcccgggtg gcatccctgt gacccctccc cagtgcctct cctggccttg gaagttgcca |
| 1861 | ctccagtgcc caccagcctt gtcctaataa aattaagttg catcattttg tctgactagg |
| 1921 | tgtcctctat aatattatgg ggtggagggg ggtggtttgg agca |

COAGULATION FACTORS
*Homo sapiens* coagulation factor VII (serum prothrombin conversion accelerator) (F7), transcript variant 2, mRNA.
ACCESSION NM_019616
VERSION NM_019616.1 GI: 10518502

(SEQ ID NO: 2474)

MVSQALRLLCLLLGLQGCLAAVFVTQEEAHGVLHRRRRANAFLEELRPGSLERECKEEQCSFEEAREIFKDAERT

KLFWISYSDGDQCASSPCQNGGSCKDQLQSYICFCLPAFEGRNCETHKDDQLICVNENGGCEQYCSDHTGTKRSC

RCHEGYSLLADGVSCTPTVEYPCGKIPILEKRNASKPQGRIVGGKVCPKGECPWQVLLLVNGAQLCGGTLINTIW

VVSAAHCFDKIKNWRNLIAVLGEHDLSEHDGDEQSRRVAQVIIPSTYVPGTTNHDIALLRLHQPVVLTDHVVPLC

RTFSERTLAFVRFSLVSGWGQLLDRGATALELPELMVLNVPRLMTQDCLQQSRKVGDSPNITEYMFCAGYSDGSK

DSCKGDSGGPHATHYRGTWYLTGIVSWGQGCATVGHFGVYTRVSQYIEWLQKLMRSEPRPGVLLRAPFP (SEQ ID NO: 2475)

| | |
|---|---|
| 1 | agtcccatgg ggaatgtcaa caggcagggg cagcactgca gagatttcat catggtctcc |
| 61 | caggccctca ggctcctctg ccttctgctt gggcttcagg gctgcctggc tgcagtcttc |
| 121 | gtaacccagg aggaagccca cggcgtcctg caccggcgcc ggcgcgccaa cgcgttcctg |
| 181 | gaggagctgc ggccgggctc cctggagagg gagtgcaagg aggagcagtg ctccttcgag |
| 241 | gaggcccggg agatcttcaa ggacgcggag aggacgaagc tgttctggat ttcttacagt |

TABLE 5-continued

| | |
|---|---|
| 301 | gatggggacc agtgtgcctc aagtccatgc cagaatgggg gctcctgcaa ggaccagctc |
| 361 | cagtcctata tctgcttctg cctccctgcc ttcgagggcc ggaactgtga gacgcacaag |
| 421 | gatgaccagc tgatctgtgt gaacgagaac ggcggctgtg agcagtactg cagtgaccac |
| 481 | acgggcacca agcgctcctg tcggtgccac gaggggtact ctctgctggc agacggggtg |
| 541 | tcctgcacac ccacagttga atatccatgt ggaaaaatac ctattctaga aaaaagaaat |
| 601 | gccagcaaac cccaaggccg aattgtgggg ggcaaggtgt gccccaaagg ggagtgtcca |
| 661 | tggcaggtcc tgttgttggt gaatggagct cagttgtgtg gggggaccct gatcaacacc |
| 721 | atctgggtgg tctccgcggc ccactgtttc gacaaaatca agaactggag gaacctgatc |
| 781 | gcggtgctgg gcgagcacga cctcagcgag cacgacgggg atgagcagag ccggcgggtg |
| 841 | gcgcaggtca tcatccccag cacgtacgtc ccgggcacca ccaaccacga catcgcgctg |
| 901 | ctccgcctgc accagcccgt ggtcctcact gaccatgtgg tgcccctctg cctgcccgaa |
| 961 | cggacgttct ctgagaggac gctggccttc gtgcgcttct cattggtcag cggctggggc |
| 1021 | cagctgctgg accgtggcgc cacggccctg gagctcatgg tgctcaacgt gccccggctg |
| 1081 | atgacccagg actgcctgca gcagtcacgg aaggtgggag actccccaaa tatcacggag |
| 1141 | tacatgttct gtgccggcta ctcggatggc agcaaggact cctgcaaggg ggacagtgga |
| 1201 | ggcccacatg ccacccacta ccggggcacg tggtacctga cgggcatcgt cagctggggc |
| 1261 | cagggctgcg caaccgtggg ccactttggg gtgtacacca gggtctccca gtacatcgag |
| 1321 | tggctgcaaa agctcatgcg ctcagagcca cgcccaggag tcctcctgcg agccccattt |
| 1381 | ccctagccca gcagccctgg cctgtggaga gaaagccaag gctgcgtcga actgtcctgg |
| 1441 | caccaaatcc catatattct tctgcagtta atggggtaga ggagggcatg ggagggaggg |
| 1501 | agaggtgggg agggagacag agacagaaac agagagagac agagacagag agagactgag |
| 1561 | ggagagactc tgaggacatg gagagagact caaagagact ccaagattca aagagactaa |
| 1621 | tagagacaca gagatggaat agaaaagatg agaggcagag gcagacaggc gctggacaga |
| 1681 | ggggcagggg agtgccaagg ttgtcctgga ggcagacagc ccagctgagc ctccttacct |
| 1741 | cccttcagcc aagccccacc tgcacgtgat ctgctggccc tcaggctgct gctctgcctt |
| 1801 | cattgctgga gacagtagag gcatgaacac acatggatgc acacacacac acgccaatgc |
| 1861 | acacacacag agatatgcac acacacggat gcacacacag atggtcacac agagatacgc |
| 1921 | aaacacaccg atgcacacgc acatagagat atgcacacac agatgcacac acagatatac |
| 1981 | acatggatgc acgcacatgc caatgcacgc acacatcagt gcacacggat gcacagagat |
| 2041 | atgcacacac cgatgtgcgc acacacagat atgcacacac atggatgagc acacacacac |
| 2101 | caagtgcgca cacacaccga tgtacacaca cagatgcaca cacagatgca cacacaccga |
| 2161 | tgctgactcc atgtgtgctg tcctctgaag gcggttgttt agctctcact tttctggttc |
| 2221 | ttatccatta tcatcttcac ttcagacaat tcagaagcat caccatgcat ggtggcgaat |
| 2281 | gcccccaaac tctcccccaa atgtatttct cccttcgctg ggtgccgggc tgcacagact |
| 2341 | attccccacc tgcttcccag cttcacaata aacggctgcg tctcctccgc acacctgtgg |
| 2401 | tgcctgccac cc |

TABLE 5-continued

*Homo sapiens* coagulation factor V (proaccelerin, labile factor) (F5), mRNA.
ACCESSION NM_000130
VERSION NM_000130.2 GI: 10518500

(SEQ ID NO: 2476)

MFPGCPRLWVLVVLGTSWVGWGSQGTEAAQLRQFYVAAQGISWSYRPEPTNSSLNLSVTSFKKIVYREYEPYFKK

EKPQSTISGLLGPTLYAEVGDIIKVHFKNKADKPLSIHPQGIRYSKLSEGASYLDHTFPAEKMDDAVAPGREYTY

EWSISEDSGPTHDDPPCLTHIYYSHENLIEDFNSGLIGPLLICKKGTLTEGGTQKTFDKQIVLLFAVFDESKSWS

QSSSLMYTVNGYVNGTMPDITVCAHDHISWHLLGMSSGPELFSIHFNGQVLEQNHHKVSAITLVSATSTTANMTV

GPEGKWIISSLTPKHLQAGMQAYIDIKNCPKKTRNLKKITREQRRHMKRWEYFIAAEEVIWDYAPVIPANMDKKY

RSQHLDNFSNQIGKHYKKVMYTQYEDESFTKHTVNPNMKEDGILGPIIRAQVRDTLKIVFKNMASRPYSIYPHGV

TFSPYEDEVNSSFTSGRNNTMIRAVQPGETYTYKWNILEFDEPTENDAQCLTRPYYSDVDIMRDIASGLIGLLLI

CKSRSLDRRGIQRAADIEQQAVFAVFDENKSWYLEDNINKFCENPDEVKRDDPKFYESNIMSTINGYVPESITTL

GFCFDDTVQWHFCSVGTQNEILTIHFTGHSFIYGKRHEDTLTLFPMRGESVTVTMDNVGTWMLTSMNSSPRSKKL

RLKFRDVKCIPDDDEDSYEIFEPPESTVMATRKMHDRLEPEDEESDADYDYQNRLAAALGIRSFRNSSLNQEEE

FNLTALALENGTEFVSSNTDIIVGSNYSSPSNISKFTVNNLAEPQKAPSHQQATTAGSPLRHLIGKNSVLNSSTA

EHSSPYSEDPIEDPLQPDVTGIRLLSLGAGEFRSQEHAKRKGPKVERDQAAKHRFSWMKLLAHKVGRHLSQDTGS

PSGMRPWEDLPSQDTGSPSRMRPWEDPPSDLLLLKQSNSSKILVGRWHLASEKGSYEIIQDTDEDTAVNNWLISP

QNASRAWGESTPLANKPGKQSGHPKFPRVRHKSLQVRQDGGKSRLKKSQFLIKTRKKKKEKHTHHAPLSPRTFHP

LRSEAYNTFSERRLKHSLVLHKSNETSLPTDLNQTLPSMDFGWIASLPDHNQNSSNDTGQASCPPGLYQTVPPEE

HYQTFPIQDPDQMHSTSDPSHRSSSPELSEMLEYDRSHKSFPTDISQMSPSSEHEVWQTVISPDLSQVTLSPELS

QTNLSPDLSHTTLSPELIQRNLSPALGQMPISPDLSHTTLSPDLSHTTLSLDLSQTNLSPELSQTNLSPALGQMP

LSPDLSHTTISLDFSQTNLSPELSHMTLSPELSQTNLSPALGQMPISPDLSHTTLSLDFSQTNLSPELSQTNLSP

ALGQMPLSPDPSHTTLSLDLSQTNLSPELSQTNLSPDLSEMPLFADLSQIPLTPDLDQMTLSPDLGETDLSPNFG

QMSLSPDLSQVTLSPDISDTTLLPDLSQISPPPDLDQIFYPSESSQSLLLQEFNESFPYPDLGQMPSPSSPTLND

TFLSKEFNPLVIVGLSKDGTDYIEIIPKEEVQSSEDDYAEIDYVPYDDPYKTDVRTNINSSRDPDNIAAWYLRSN

NGNRRNYYIAAEEISWDYSEFVQRETDIEDSDDIPEDTTYKKVVFRKYLDSTFTKRDPRGEYEEHLGILGPIIRA

EVDDVIQVRFKNLASRPYSLHAHGLSYEKSSEGKTYEDDSPEWFKEDNAVQPNSSYTYVWHATERSGPESPGSAC

RAWAYYSAVNPEKDIHSGLIGPLLICQKGILHKDSNMPVDMREFVLLFMTFDEKKSWYYEKKSRSSWRLTSSEMK

KSHEFHAINGMIYSLPGLKMYEQEWVRLHLLNIGGSQDIHVVHFHGQTLLENGNKQHQLGVWPLLPGSFKTLEMK

ASKPGWWLLNTEVGENQRAGMQTPFLIMDRDCRMPMGLSTGIISDSQIKASEFLGYWEPRLARLNNGGSYNAWSV

EKLAAEFASKPWIQVDMQKEVIITGIQTQGAKHYLKSCYTTEFYVAYSSNQINWQIFKGNSTRNVMYFNGNSDAS

TIKENQFDPPIVARYIRISPTRAYNRPTLRLELQGCEVNGCSTPLGMENGKIENKQITASSFKKSWWGDYWEPFR

ARLNAQGRVNAWQAKANNNKQWLEIDLLKIKKITAIITQGCKSLSSEMYVKSYTIHYSEQGVEWKPYRLKSSMVD

KIFEGNTNTKGHVKNFFNPPIISRFIRVIPKTWNQSIALRLELFGCDIY"

(SEQ ID NO: 2477)

```
  1 tcattgcagc tgggacagcc cggagtgtgg ttagcagctc ggcaagcgct gcccaggtcc

 61 tggggtggtg gcagccagcg ggagcaggaa aggaagcatg ttcccaggct gcccacgcct

121 ctgggtcctg gtggtcttgg gcaccagctg ggtaggctgg gggagccaag ggacagaagc

181 ggcacagcta aggcagttct acgtggctgc tcagggcatc agttggagct accgacctga

241 gcccacaaac tcaagtttga atctttctgt aacttccttt aagaaaattg tctacagaga

301 gtatgaacca tattttaaga aagaaaaacc acaatctacc atttcaggac ttcttgggcc

361 tactttatat gctgaagtcg gagacatcat aaaagttcac tttaaaaata aggcagataa
```

TABLE 5-continued

| | |
|---|---|
| 421 | gcccttgagc atccatcctc aaggaattag gtacagtaaa ttatcagaag gtgcttctta |
| 481 | ccttgaccac acattccctg cagagaagat ggacgacgct gtggctccag gccgagaata |
| 541 | cacctatgaa tggagtatca gtgaggacag tggacccacc catgatgacc ctccatgcct |
| 601 | cacacacatc tattactccc atgaaaatct gatcgaggat ttcaactctg ggctgattgg |
| 661 | gcccctgctt atctgtaaaa aagggaccct aactgagggt gggacacaga agacgtttga |
| 721 | caagcaaatc gtgctactat ttgctgtgtt tgatgaaagc aagagctgga gccagtcatc |
| 781 | atccctaatg tacacagtca atggatatgt gaatgggaca atgccagata taacagtttg |
| 841 | tgcccatgac cacatcagct ggcatctgct gggaatgagc tcggggccag aattattctc |
| 901 | cattcatttc aacggccagg tcctggagca gaaccatcat aaggtctcag ccatcaccct |
| 961 | tgtcagtgct acatccacta ccgcaaatat gactgtgggc ccagagggaa agtggatcat |
| 1021 | atcttctctc accccaaaac atttgcaagc tgggatgcag gcttacattg acattaaaaa |
| 1081 | ctgcccaaag aaaaccagga atcttaagaa aataactcgt gagcagaggc ggcacatgaa |
| 1141 | gaggtgggaa tacttcattg ctgcagagga agtcatttgg gactatgcac ctgtaatacc |
| 1201 | agcgaatatg gacaaaaaat acaggtctca gcatttggat aatttctcaa accaaattgg |
| 1261 | aaaacattat aagaaagtta tgtacacaca gtacgaagat gagtccttca ccaaacatac |
| 1321 | agtgaatccc aatatgaaag aagatgggat tttgggtcct attatcagag cccaggtcag |
| 1381 | agacacactc aaaatcgtgt tcaaaaatat ggccagccgc ccctatagca tttaccctca |
| 1441 | tggagtgacc ttctcgcctt atgaagatga agtcaactct tctttcacct caggcaggaa |
| 1501 | caacaccatg atcagagcag ttcaaccagg ggaaacctat acttataagt ggaacatctt |
| 1561 | agagtttgat gaacccacag aaaatgatgc ccagtgctta acaagaccat actacagtga |
| 1621 | cgtggacatc atgagagaca tcgcctctgg gctaatagga ctacttctaa tctgtaagag |
| 1681 | cagatccctg gacaggcgag gaatacagag ggcagcagac atcgaacagc aggctgtgtt |
| 1741 | tgctgtgttt gatgagaaca aaagctggta ccttgaggac aacatcaaca agttttgtga |
| 1801 | aaatcctgat gaggtgaaac gtgatgaccc caagttttat gaatcaaaca tcatgagcac |
| 1861 | tatcaatggc tatgtgcctg agagcataac tactcttgga ttctgctttg atgacactgt |
| 1921 | ccagtggcac ttctgtagtg tggggaccca gaatgaaatt ttgaccatcc acttcactgg |
| 1981 | gcactcattc atctatggaa agaggcatga ggacaccttg accctcttcc ccatgcgtgg |
| 2041 | agaatctgtg acggtcacaa tggataatgt tggaacttgg atgttaactt ccatgaattc |
| 2101 | tagtccaaga agcaaaaagc tgaggctgaa attcagggat gttaaatgta tcccagatga |
| 2161 | tgatgaagac tcatatgaga tttttgaacc tccagaatct acagtcatgg ctacacggaa |
| 2221 | aatgcatgat cgtttagaac ctgaagatga agagagtgat gctgactatg attaccagaa |
| 2281 | cagactggct gcagcattag gaattaggtc attccgaaac tcatcattga accaggaaga |
| 2341 | agaagagttc aatcttactg ccctagctct ggagaatggc actgaattcg tttcttcgaa |
| 2401 | cacagatata attgttggtt caaattattc ttccccaagt aatattagta agttcactgt |
| 2461 | caataacctt gcagaacctc agaaagcccc ttctcaccaa caagccacca cagctggttc |
| 2521 | cccactgaga cacctcattg gcaagaactc agttctcaat tcttccacag cagagcattc |
| 2581 | cagcccatat tctgaagacc ctatagagga tcctctacag ccagatgtca cagggatacg |
| 2641 | tctactttca cttggtgctg gagaattcag aagtcaagaa catgctaagc gtaagggacc |
| 2701 | caaggtagaa agagatcaag cagcaaagca caggttctcc tggatgaaat tactagcaca |
| 2761 | taaagttggg agacacctaa gccaagacac tggttctcct tccggaatga ggccctggga |

TABLE 5-continued

| | |
|---|---|
| 2821 | ggaccttcct agccaagaca ctggttctcc ttccagaatg aggccctggg aggaccctcc |
| 2881 | tagtgatctg ttactcttaa aacaaagtaa ctcatctaag attttggttg ggagatggca |
| 2941 | tttggcttct gagaaaggta gctatgaaat aatccaagat actgatgaag acacagctgt |
| 3001 | taacaattgg ctgatcagcc cccagaatgc ctcacgtgct tggggagaaa gcacccctct |
| 3061 | tgccaacaag cctggaaagc agagtggcca cccaaagttt cctagagtta gacataaatc |
| 3121 | tctacaagta agacaggatg gaggaaagag tagactgaag aaaagccagt ttctcattaa |
| 3181 | gacacgaaaa aagaaaaaag agaagcacac acaccatgct cctttatctc cgaggacctt |
| 3241 | tcaccctcta agaagtgaag cctacaacac attttcagaa agaagactta agcattcgtt |
| 3301 | ggtgcttcat aaatccaatg aaacatctct tcccacagac ctcaatcaga cattgccctc |
| 3361 | tatggatttt ggctggatag cctcacttcc tgaccataat cagaattcct caaatgacac |
| 3421 | tggtcaggca agctgtcctc caggtcttta tcagacagtg cccccagagg aacactatca |
| 3481 | aacattcccc attcaagacc ctgatcaaat gcactctact tcagacccca gtcacagatc |
| 3541 | ctcttctcca gagctcagtg aaatgcttga gtatgaccga agtcacaagt ccttccccac |
| 3601 | agatataagt caaatgtccc cttcctcaga acatgaagtc tggcagacag tcatctctcc |
| 3661 | agacctcagc caggtgaccc tctctccaga actcagccag acaaacctct ctccagacct |
| 3721 | cagccacacg actctctctc cagaactcat tcagagaaac ctttccccag ccctcggtca |
| 3781 | gatgcccatt tctccagacc tcagccatac aaccctttct ccagacctca gccatacaac |
| 3841 | cctttcttta gacctcagcc agacaaacct ctctccagaa ctcagtcaga caaacctttc |
| 3901 | tccagccctc ggtcagatgc cccttttctcc agacctcagc catacaacca tttctctaga |
| 3961 | cttcagccag acaaacctct ctccagaact cagccatatg actctctctc cagaactcag |
| 4021 | tcagacaaac ctttccccag ccctcggtca gatgcccatt tctccagacc tcagccatac |
| 4081 | aaccctttct ctagacttca gccagacaaa cctctctcca gaactcagtc aaacaaacct |
| 4141 | ttccccagcc ctcggtcaga tgcccctttc tccagacccc agccatacaa ccctttctct |
| 4201 | agacctcagc cagacaaacc tctctccaga actcagtcag acaaaccttt ccccagacct |
| 4261 | cagtgagatg cccctctttg cagatctcag tcaaattccc cttaccccag acctcgacca |
| 4321 | gatgacactt tctccagacc ttggtgagac agatctttcc ccaaactttg gtcagatgtc |
| 4381 | cctttcccca gacctcagcc aggtgactct ctctccagac atcagtgaca ccacccttct |
| 4441 | cccggatctc agccagatat cacctcctcc agaccttgat cagatattct acccttctga |
| 4501 | atctagtcag tcattgcttc ttcaagaatt taatgagtct tttccttatc cagaccttgg |
| 4561 | tcagatgcca tctccttcat ctcctactct caatgatact tttctatcaa aggaatttaa |
| 4621 | tccactggtt atagtgggcc tcagtaaaga tggtacagat tacattgaga tcattccaaa |
| 4681 | ggaagaggtc cagagcagtg aagatgacta tgctgaaatt gattatgtgc cctatgatga |
| 4741 | cccctacaaa actgatgtta ggacaaacat caactcctcc agagatcctg acaacattgc |
| 4801 | agcatggtac ctccgcagca acaatggaaa cagaagaaat tattacattg ctgctgaaga |
| 4861 | aatatcctgg gattattcag aatttgtaca aagggaaaca gatattgaag actctgatga |
| 4921 | tattccagaa gataccacat ataagaaagt agtttttcga aagtacctcg acagcacttt |
| 4981 | taccaaacgt gatcctcgag gggagtatga agagcatctc ggaattcttg gtcctattat |
| 5041 | cagagctgaa gtggatgatg ttatccaagt tcgttttaaa aatttagcat ccagaccgta |
| 5101 | ttctctacat gcccatggac tttcctatga aaaatcatca gagggaaaga cttatgaaga |
| 5161 | tgactctcct gaatggttta aggaagataa tgctgttcag ccaaatagca gttataccta |

TABLE 5-continued

| | |
|---|---|
| 5221 | cgtatggcat gccactgagc gatcagggcc agaaagtcct ggctctgcct gtcgggcttg |
| 5281 | ggcctactac tcagctgtga acccagaaaa agatattcac tcaggcttga taggtcccct |
| 5341 | cctaatctgc caaaaaggaa tactacataa ggacagcaac atgcctgtgg acatgagaga |
| 5401 | atttgtctta ctatttatga cctttgatga aaagaagagc tggtactatg aaaagaagtc |
| 5461 | ccgaagttct tggagactca catcctcaga aatgaaaaaa tcccatgagt ttcacgccat |
| 5521 | taatgggatg atctacagct tgcctggcct gaaaatgtat gagcaagagt gggtgaggtt |
| 5581 | acacctgctg aacataggcg gctcccaaga cattcacgtg gttcactttc acggccagac |
| 5641 | cttgctggaa aatggcaata aacagcacca gttaggggtc tggccccttc tgcctggttc |
| 5701 | atttaaaact cttgaaatga aggcatcaaa acctggctgg tggctcctaa acacagaggt |
| 5761 | tggagaaaac cagagagcag ggatgcaaac gccatttctt atcatggaca gagactgtag |
| 5821 | gatgccaatg ggactaagca ctggtatcat atctgattca cagatcaagg cttcagagtt |
| 5881 | tctgggttac tgggagccca gattagcaag attaaacaat ggtggatctt ataatgcttg |
| 5941 | gagtgtagaa aaacttgcag cagaatttgc ctctaaacct tggatccagg tggacatgca |
| 6001 | aaaggaagtc ataatcacag ggatccagac ccaaggtgcc aaacactacc tgaagtcctg |
| 6061 | ctataccaca gagttctatg tagcttacag ttccaaccag atcaactggc agatcttcaa |
| 6121 | agggaacagc acaaggaatg tgatgtattt taatggcaat tcagatgcct ctacaataaa |
| 6181 | agagaatcag tttgacccac ctattgtggc tagatatatt aggatctctc caactcgagc |
| 6241 | ctataacaga cctacccttc gattggaact gcaaggttgt gaggtaaatg gatgttccac |
| 6301 | acccctgggt atggaaaatg gaaagataga aaacaagcaa atcacagctt cttcgtttaa |
| 6361 | gaaatcttgg tggggagatt actgggaacc cttccgtgcc cgtctgaatg cccagggacg |
| 6421 | tgtgaatgcc tggcaagcca aggcaaacaa caataagcag tggctagaaa ttgatctact |
| 6481 | caagatcaag aagataacgg caattataac acagggctgc aagtctctgt cctctgaaat |
| 6541 | gtatgtaaag agctatacca tccactacag tgagcaggga gtggaatgga aaccatacag |
| 6601 | gctgaaatcc tccatggtgg acaagatttt tgaaggaaat actaatacca aaggacatgt |
| 6661 | gaagaacttt ttcaaccccc caatcatttc caggtttatc cgtgtcattc ctaaaacatg |
| 6721 | gaatcaaagt attgcacttc gcctggaact ctttggctgt gatatttact agaattgaac |
| 6781 | attcaaaaac ccctggaaga gactctttaa gacctcaaac catttagaat gggcaatgta |
| 6841 | ttttacgctg tgttaaatgt taacagtttt ccactatttc tctttctttt ctattagtga |
| 6901 | ataaaatttt atac |

*Homo sapiens* coagulation factor II (thrombin) (F2), mRNA.
ACCESSION NM_000506
VERSION NM_000506.2 GI: 5922005

(SEQ ID NO: 2478)

MAHVRGLQLPGCLALAALCSLVHSQHVFLAPQQARSLLQRVRRANTFLEEVRKGNLERECVEETCSYEEAFEALE

SSTATDVFWAKYTACETARTPRDKLAACLEGNCAEGLGTNYRGHVNITRSGIECQLWRSRYPHKPEINSTTHPGA

DLQENFCRNPDSSTTGPWCYTTDPTVRRQECSIPVCGQDQVTVAMTPRSEGSSVNLSPPLEQCVPDRGQQYQGRL

AVTTHGLPCLAWASAQAKALSKHQDFNSAVQLVENFCRNPDGDEEGVWCYVAGKPGDFGYCDLNYCEEAVEEETG

DGLDEDSDRAIEGRTATSEYQTFFNPRTFGSGEADCGLRPLFEKKSLEDKTERELLESYIDGRIVEGSDAEIGMS

PWQVMLFRKSPQELLCGASLISDRWVLTAAHCLLYPPWDKNFTENDLLVRIGKHSRTRYERNIEKISMLEKIYIH

PRYNWRENLDRDIALMKLKKPVAFSDYIHPVCLPDRETAASLLQAGYKGRVTGWGNLKETWTANVGKGQPSVLQV

VNLPIVERPVCKDSTRIRITDNMFCAGYKPDEGKRGDACEGDSGGPFVMKSPFNNRWYQMGIVSWGEGCDRDGKY

GFYTHVFRLKKWIQKVIDQFGE"

TABLE 5-continued

| |
|---|
| (SEQ ID NO: 2479) |
| 1 aattcctcag tgacccagga gctgacacac tatggcgcac gtccgaggct tgcagctgcc |
| 61 tggctgcctg gccctggctg ccctgtgtag ccttgtgcac agccagcatg tgttcctggc |
| 121 tcctcagcaa gcacggtcgc tgctccagcg ggtccggcga gccaacacct tcttggagga |
| 181 ggtgcgcaag ggcaacctag agcgagagtg cgtggaggag acgtgcagct acgaggaggc |
| 241 cttcgaggct ctggagtcct ccacggctac ggatgtgttc tgggccaagt acacagcttg |
| 301 tgagacagcg aggacgcctc gagataagct tgctgcatgt ctggaaggta actgtgctga |
| 361 gggtctgggt acgaactacc gagggcatgt gaacatcacc cggtcaggca ttgagtgcca |
| 421 gctatggagg agtcgctacc cacataagcc tgaaatcaac tccactaccc atcctggggc |
| 481 cgacctacag gagaatttct gccgcaaccc cgacagcagc accacgggac cctggtgcta |
| 541 cactacagac ccccaccgtga ggaggcagga atgcagcatc cctgtctgtg gccaggatca |
| 601 agtcactgta gcgatgactc cacgctccga aggctccagt gtgaatctgt cacctccatt |
| 661 ggagcagtgt gtccctgatc gggggcagca gtaccagggg cgcctggcgg tgaccacaca |
| 721 tgggctcccc tgcctggcct gggccagcgc acaggccaag gccctgagca agcaccagga |
| 781 cttcaactca gctgtgcagc tggtggagaa cttctgccgc aacccagacg gggatgagga |
| 841 gggcgtgtgg tgctatgtgg ccgggaagcc tggcgacttt gggtactgcg acctcaacta |
| 901 ttgtgaggag gccgtggagg aggagacagg agatgggctg gatgaggact cagacagggc |
| 961 catcgaaggg cgtaccgcca ccagtgagta ccagactttc ttcaatccga ggacctttgg |
| 1021 ctcgggagag gcagactgtg ggctgcgacc tctgttcgag aagaagtcgc tggaggacaa |
| 1081 aaccgaaaga gagctcctgg aatcctacat cgacgggcgc attgtggagg gctcggatgc |
| 1141 agagatcggc atgtcacctt ggcaggtgat gcttttccgg aagagtcccc aggagctgct |
| 1201 gtgtggggcc agcctcatca gtgaccgctg ggtcctcacc gccgcccact gcctcctgta |
| 1261 cccgccctgg gacaagaact tcaccgagaa tgaccttctg gtgcgcattg gcaagcactc |
| 1321 ccgcacaagg tacgagcgaa acattgaaaa gatatccatg ttggaaaaga tctacatcca |
| 1381 ccccaggtac aactggcggg agaacctgga ccgggacatt gccctgatga agctgaagaa |
| 1441 gcctgttgcc ttcagtgact acattcaccc tgtgtgtctg cccgacaggg agacggcagc |
| 1501 cagcttgctc caggctggat acaaggggcg ggtgacaggc tggggcaacc tgaaggagac |
| 1561 gtggacagcc aacgttggta aggggcagcc cagtgtcctg caggtggtga acctgcccat |
| 1621 tgtggagcgg ccggtctgca aggactccac ccggatccgc atcactgaca acatgttctg |
| 1681 tgctggttac aagcctgatg aagggaaacg aggggatgcc tgtgaaggtg acagtggggg |
| 1741 accctttgtc atgaagagcc cctttaacaa ccgctggtat caaatgggca tcgtctcatg |
| 1801 gggtgaaggc tgtgaccggg atgggaaata tggcttctac acacatgtgt tccgcctgaa |
| 1861 gaagtggata cagaaggtca ttgatcagtt tggagagtag gggccactca tattctgggc |
| 1921 tcctggaacc aatcccgtga aagaattatt tttgtgtttc taaaactatg gttcccaata |
| 1981 aaagtgactc tcagcgg |

1 aattcctcag tgacccagga gctgacacac tatggcgcac gtccgaggct tgcagctgcc

TABLE 6

| | | | | | | | | | | | | | | | |
|---|---|---|---|---|---|---|---|---|---|---|---|---|---|---|---|
| Ala | Pro | Pro | Arg | Leu | Ile | Cys | Asp | Ser | Arg | Val | Leu | Glu | Arg | Tyr | Leu |
| 1 | | | | 5 | | | | | 10 | | | | | 15 | |

TABLE 6-continued

Leu Glu Ala Lys Glu Ala Glu Asn Ile Thr Thr Gly Cys Ala Glu His
20 25 30

Cys Ser Leu Asn Glu Asn Ile Thr Val Pro Asp Thr Lys Val Asn Phe
35 40 45

Tyr Ala Trp Lys Arg Met Glu Val Gly Gln Gln Ala Val Glu Val Trp
50 55 60

Gln Gly Leu Ala Leu Leu Ser Glu Ala Val Leu Arg Gly Gln Ala Leu
65 70 75 80

Leu Val Asn Ser Ser Gln Pro Trp Glu Pro Leu Gln Leu His Val Asp
85 90 95

Lys Ala Val Ser Gly Leu Arg Ser Leu Thr Thr Leu Leu Arg Ala Leu
100 105 110

Gly Ala Gln Lys Glu Ala Ile Ser Pro Pro Asp Ala Ala Ser Ala Ala
115 120 125

Pro Leu Arg Thr Ile Thr Ala Asp Thr Phe Arg Lys Leu Phe Arg Val
130 135 140

Tyr Ser Asn Phe Leu Arg Gly Lys Leu Lys Leu Tyr Thr Gly Glu Ala
145 150 155 160

Cys Arg Thr Gly Asp (SEQ ID NO: 2480)

Ala Pro Pro Arg Leu Ile Cys Asp Ser Arg Val Leu Glu Arg Tyr Leu
1 5 10 15

Leu Glu Ala Lys Glu Ala Glu Asn Ile Thr Thr Gly Cys Ala Glu His
20 25 30

Cys Ser Leu Asn Glu Asn Ile Thr Val Pro Asp Thr Lys Val Asn Phe
35 40 45

Tyr Ala Trp Lys Arg Met Glu Val Gly Gln Gln Ala Val Glu Val Trp
50 55 60

Gln Gly Leu Ala Leu Leu Ser Glu Ala Val Leu Arg Gly Gln Ala Leu
65 70 75 80

Leu Val Asn Ser Ser Gln Pro Trp Glu Pro Leu Gln Leu His Val Asp
85 90 95

Lys Ala Val Ser Gly Leu Arg Ser Leu Thr Thr Leu Leu Arg Ala Leu
100 105 110

Gly Ala Gln Lys Glu Ala Ile Ser Pro Pro Asp Ala Ala Ser Ala Ala
115 120 125

Pro Leu Arg Thr Ile Thr Ala Asp Thr Phe Arg Lys Leu Phe Arg Val
130 135 140

Tyr Ser Asn Phe Leu Arg Gly Lys Leu Lys Leu Tyr Thr Gly Glu Ala
145 150 155 160

Cys Arg Thr Gly Asp Arg (SEQ ID NO: 2481)
165

TABLE 7

| (SEQ ID NOS: 2482-4747, respectively, in order of appearance) |
|---|
| N(Asparagine) as major constituent<br>Oligonucleotides of peptide motifs containing 3-7 amino acid residues with N(Asparagine) as the major constituent and T(Threonine) as the minor constituent |
| AAY-AAY-ACN, ACN-AAY-AAY, AAY-ACN-AAY, AAY-AAY-AAY-ACN, ACN-AAY-AAY-AAY, AAY-ACN-AAY-AAY, AAY-AAY-ACN-AAY, AAY-AAY-AAY-AAY-ACN, ACN-AAY-AAY-AAY-AAY, AAY-ACN-AAY-AAY-AAY, AAY-AAY- |

TABLE 7-continued

| (SEQ ID NOS: 2482-4747, respectively, in order of appearance) |
| --- |

ACN-AAY-AAY, AAY-AAY-AAY-ACN-AAY, AAY-AAY-AAY-ACN-ACN, ACN-
ACN-AAY-AAY-AAY, ACN-AAY-ACN-AAY-AAY, ACN-AAY-AAY-ACN-AAY,
ACN-AAY-AAY-AAY-ACN, AAY-ACN-ACN-AAY-AAY, AAY-ACN-AAY-ACN-
AAY, AAY-ACN-AAY-AAY-ACN, AAY-AAY-ACN-ACN-AAY, AAY-AAY-ACN-
AAY-ACN, AAY-AAY-AAY-AAY-AAY-ACN, ACN-AAY-AAY-AAY-AAY-AAY,
AAY-ACN-AAY-AAY-AAY-AAY, AAY-AAY-ACN-AAY-AAY-AAY, AAY-AAY-
AAY-ACN-AAY-AAY, AAY-AAY-AAY-AAY-ACN-AAY, AAY-AAY-AAY-AAY-
ACN-ACN, ACN-ACN-AAY-AAY-AAY-AAY, ACN-AAY-ACN-AAY-AAY-AAY,
ACN-AAY-AAY-ACN-AAY-AAY, ACN-AAY-AAY-AAY-ACN-AAY, ACN-AAY-
AAY-AAY-AAY-ACN, AAY-ACN-ACN-AAY-AAY-AAY, AAY-ACN-AAY-ACN-
AAY-AAY, AAY-ACN-AAY-AAY-ACN-AAY, AAY-ACN-AAY-AAY-AAY-ACN,
AAY-AAY-ACN-ACN-AAY-AAY, AAY-AAY-ACN-AAY-ACN-AAY, AAY-AAY-
ACN-AAY-AAY-ACN, AAY-AAY-AAY-ACN-ACN-AAY, AAY-AAY-AAY-ACN-
AAY-ACN, AAY-AAY-AAY-AAY-ACN-ACN-ACN, ACN-ACN-ACN-AAY-AAY-
AY-ACN-ACN-AAY-AAY-AAY, ACN-AAY-ACN-AAY-ACN-
AAY-AAY, ACN-AAY-ACN-AAY-AAY-ACN-AAY, ACN-AAY-ACN-AAY-AAY-
AAY-ACN, ACN-AAY-AAY-ACN-ACN-AAY-AAY, ACN-AAY-AAY-ACN-AAY-
ACN-AAY, ACN-AAY-AAY-ACN-AAY-AAY-ACN, ACN-AAY-AAY-AAY-ACN-
AAY-ACN, ACN-AAY-AAY-AAY-ACN-ACN-AAY, ACN-AAY-AAY-AAY-AAY-
ACN-ACN, ACN-ACN-AAY-ACN-AAY-AAY-AAY, ACN-ACN-AAY-AAY-ACN-
AAY-AAY, ACN-ACN-AAY-AAY-AAY-ACN-AAY, ACN-ACN-AAY-AAY-AAY-
AAY-ACN, AAY-ACN-ACN-ACN-AAY-AAY-AAY, AAY-ACN-ACN-AAY-ACN-
AAY-AAY, AAY-ACN-ACN-AAY-AAY-ACN-AAY, AAY-ACN-ACN-AAY-AAY-
AAY-ACN, AAY-ACN-AAY-ACN-ACN-AAY-AAY, AAY-ACN-AAY-AAY-ACN-
ACN-AAY, AAY-ACN-AAY-AAY-AAY-ACN-ACN, AAY-ACN-AAY-ACN-AAY-
ACN-AAY, AAY-ACN-AAY-ACN-AAY-AAY-ACN, AAY-ACN-AAY-AAY-ACN-
AAY-ACN, AAY-AAY-ACN-ACN-ACN-AAY-AAY, AAY-AAY-ACN-ACN-AAY-
ACN-AAY, AAY-AAY-ACN-ACN-AAY-AAY-ACN, AAY-AAY-ACN-AAY-ACN-
ACN-AAY, AAY-AAY-ACN-AAY-ACN-AAY-ACN, AAY-AAY-ACN-AAY-AAY-
ACN-ACN, AAY-AAY-AAY-ACN-ACN-ACN-AAY, AAY-AAY-AAY-ACN-ACN-
AAY-ACN, AAY-AAY-AAY-ACN-AAY-ACN-ACN, AAY-AAY-AAY-AAY-AAY-
ACN-ACN, ACN-ACN-AAY-AAY-AAY-AAY-AAY, ACN-AAY-ACN-AAY-AAY-
AAY-AAY, ACN-AAY-AAY-ACN-AAY-AAY-AAY, ACN-AAY-AAY-AAY-ACN-
AAY-AAY, ACN-AAY-AAY-AAY-AAY-ACN-AAY, ACN-AAY-AAY-AAY-AAY-
AAY-ACN, AAY-ACN-ACN-AAY-AAY-AAY-AAY, AAY-ACN-AAY-ACN-AAY-
AAY-AAY, AAY-ACN-AAY-AAY-ACN-AAY-AAY, AAY-ACN-AAY-AAY-AAY-
ACN-AAY, AAY-ACN-AAY-AAY-AAY-AAY-ACN, AAY-AAY-ACN-ACN-AAY-
AAY-AAY, AAY-AAY-ACN-AAY-ACN-AAY-AAY, AAY-AAY-ACN-AAY-AAY-

TABLE 7-continued

| (SEQ ID NOS: 2482-4747, respectively, in order of appearance) |
|---|
| ACN-AAY, AAY-AAY-ACN-AAY-AAY-AAY-ACN, AAY-AAY-AAY-ACN-ACN-AAY-AAY, AAY-AAY-AAY-ACN-AAY-ACN-AAY, AAY-AAY-AAY-ACN-AAY-AAY-ACN, AAY-AAY-AAY-AAY-ACN-ACN-AAY, AAY-AAY-AAY-AAY-ACN-AAY-ACN, AAY-AAY-AAY-AAY-AAY-AAY-ACN, ACN-AAY-AAY-AAY-AAY-AAY-AAY, AAY-ACN-AAY-AAY-AAY-AAY-AAY, AAY-AAY-ACN-AAY-AAY-AAY-AAY, AAY-AAY-AAY-ACN-AAY-AAY-AAY, AAY-AAY-AAY-AAY-ACN-AAY-AAY, AAY-AAY-AAY-AAY-AAY-ACN-AAY |
| Oligonucleotides of peptide motifs containing 3-7 amino acid residues with N(Asparagine) as the major constituent and A(Alanine) as the minor constituent |
| AAY-AAY-GCN, GCN-AAY-AAY, AAY-GCN-AAY, AAY-AAY-AAY-GCN, GCN-AAY-AAY-AAY, AAY-GCN-AAY-AAY, AAY-AAY-GCN-AAY, AAY-AAY-AAY-AAY-GCN, GCN-AAY-AAY-AAY-AAY, AAY-GCN-AAY-AAY-AAY, AAY-AAY-GCN-AAY-AAY, AAY-AAY-AAY-GCN-AAY, AAY-AAY-AAY-GCN-GCN, GCN-GCN-AAY-AAY-AAY, GCN-AAY-GCN-AAY-AAY, GCN-AAY-AAY-GCN-AAY, GCN-AAY-AAY-AAY-GCN, AAY-GCN-GCN-AAY-AAY, AAY-GCN-AAY-GCN-AAY, AAY-GCN-AAY-AAY-GCN, AAY-AAY-GCN-GCN-AAY, AAY-AAY-GCN-AAY-GCN, AAY-AAY-AAY-AAY-AAY-GCN, GCN-AAY-AAY-AAY-AAY-AAY, AAY-GCN-AAY-AAY-AAY-AAY, AAY-AAY-GCN-AAY-AAY-AAY, AAY-AAY-AAY-GCN-AAY-AAY, AAY-AAY-AAY-AAY-GCN-AAY, AAY-AAY-AAY-AAY-GCN-GCN, GCN-GCN-AAY-AAY-AAY-AAY, GCN-AAY-GCN-AAY-AAY-AAY, GCN-AAY-AAY-GCN-AAY-AAY, GCN-AAY-AAY-AAY-GCN-AAY, GCN-AAY-AAY-AAY-AAY-GCN, AAY-GCN-GCN-AAY-AAY-AAY, AAY-GCN-AAY-GCN-AAY-AAY, AAY-GCN-AAY-AAY-GCN-AAY, AAY-GCN-AAY-AAY-AAY-GCN, AAY-AAY-GCN-GCN-AAY-AAY, AAY-AAY-GCN-AAY-GCN-AAY, AAY-AAY-GCN-AAY-AAY-GCN, AAY-AAY-AAY-GCN-GCN-AAY, AAY-AAY-AAY-GCN-AAY-GCN, AAY-AAY-AAY-AAY-GCN-GCN-GCN, GCN-GCN-GCN-AAY-AAY-AAY-AAY, GCN-AAY-GCN-GCN-AAY-AAY-AAY, GCN-AAY-GCN-AAY-GCN-AAY-AAY, GCN-AAY-GCN-AAY-AAY-GCN-AAY, GCN-AAY-GCN-AAY-AAY-AAY-GCN, GCN-AAY-AAY-GCN-GCN-AAY-AAY, GCN-AAY-AAY-GCN-AAY-GCN-AAY, GCN-AAY-AAY-GCN-AAY-AAY-GCN, GCN-AAY-AAY-AAY-GCN-AAY-GCN, GCN-AAY-AAY-AAY-GCN-GCN-AAY, GCN-AAY-AAY-AAY-AAY-GCN-GCN, GCN-GCN-AAY-GCN-AAY-AAY-AAY, GCN-GCN-AAY-AAY-GCN-AAY-AAY, GCN-GCN-AAY-AAY-AAY-GCN-AAY, GCN-GCN-AAY-AAY-AAY-AAY-GCN, AAY-GCN-GCN-GCN-AAY-AAY-AAY, AAY-GCN-GCN-AAY-GCN-AAY-AAY, AAY-GCN-GCN-AAY-AAY-GCN-AAY, AAY-GCN-GCN-AAY-AAY-AAY-GCN, AAY-GCN-AAY-GCN-GCN-AAY-AAY, AAY-GCN-AAY-AAY-GCN-GCN-AAY, AAY-GCN-AAY-AAY-AAY-GCN-GCN, AAY-GCN-AAY-GCN-AAY-GCN-AAY, AAY-GCN-AAY-GCN-AAY-AAY-GCN, AAY-GCN-AAY-AAY-GCN-AAY-GCN, AAY-AAY-GCN-GCN-GCN-AAY-AAY, AAY-AAY-GCN-GCN-AAY- |

TABLE 7-continued

| (SEQ ID NOS: 2482-4747, respectively, in order of appearance) |
|---|
| GCN-AAY, AAY-AAY-GCN-GCN-AAY-AAY-GCN, AAY-AAY-GCN-AAY-GCN-GCN-AAY, AAY-AAY-GCN-AAY-GCN-AAY-GCN, AAY-AAY-GCN-AAY-AAY-GCN-GCN, AAY-AAY-AAY-GCN-GCN-GCN-AAY, AAY-AAY-AAY-GCN-GCN-AAY-GCN, AAY-AAY-AAY-GCN-AAY-GCN-GCN, AAY-AAY-AAY-AAY-AAY-GCN-GCN, GCN-GCN-AAY-AAY-AAY-AAY-AAY, GCN-AAY-GCN-AAY-AAY-AAY-AAY, GCN-AAY-AAY-GCN-AAY-AAY-AAY, GCN-AAY-AAY-AAY-GCN-AAY-AAY, GCN-AAY-AAY-AAY-AAY-GCN-AAY, GCN-AAY-AAY-AAY-AAY-AAY-GCN, AAY-GCN-GCN-AAY-AAY-AAY-AAY, AAY-GCN-AAY-GCN-AAY-AAY-AAY, AAY-GCN-AAY-AAY-GCN-AAY-AAY, AAY-GCN-AAY-AAY-AAY-GCN-AAY, AAY-GCN-AAY-AAY-AAY-AAY-GCN, AAY-AAY-GCN-GCN-AAY-AAY-AAY, AAY-AAY-GCN-AAY-GCN-AAY-AAY, AAY-AAY-GCN-AAY-AAY-GCN-AAY, AAY-AAY-GCN-AAY-AAY-AAY-GCN, AAY-AAY-AAY-GCN-GCN-AAY-AAY, AAY-AAY-AAY-GCN-AAY-GCN-AAY, AAY-AAY-AAY-GCN-AAY-AAY-GCN, AAY-AAY-AAY-AAY-GCN-GCN-AAY, AAY-AAY-AAY-AAY-GCN-AAY-GCN-AAY-AAY-AAY-AAY-AAY-AAY-GCN, GCN-AAY-AAY-AAY-AAY-AAY-AAY, AAY-GCN-AAY-AAY-AAY-AAY-AAY, AAY-AAY-GCN-AAY-AAY-AAY-AAY, AAY-AAY-AAY-GCN-AAY-AAY-AAY, AAY-AAY-AAY-AAY-GCN-AAY-AAY, AAY-AAY-AAY-AAY-AAY-GCN-AAY |
| Oligonucleotides of peptide motifs containing 3-7 amino acid residues with N(Asparagine) as the major constituent and S(Serine) as the minor constituent |
| AAY-AAY-AGY, AGY-AAY-AAY, AAY-AGY-AAY, AAY-AAY-AAY-AGY, AGY-AAY-AAY-AAY, AAY-AGY-AAY-AAY, AAY-AAY-AGY-AAY, AAY-AAY-AAY-AAY-AGY, AGY-AAY-AAY-AAY-AAY, AAY-AGY-AAY-AAY-AAY, AAY-AAY-AGY-AAY-AAY, AAY-AAY-AAY-AGY-AAY, AAY-AAY-AAY-AGY-AGY, AGY-AGY-AAY-AAY-AAY, AGY-AAY-AGY-AAY-AAY, AGY-AAY-AAY-AGY-AAY, AGY-AAY-AAY-AAY-AGY, AAY-AGY-AGY-AAY-AAY, AAY-AGY-AAY-AGY-AAY, AAY-AGY-AAY-AAY-AGY, AAY-AAY-AGY-AGY-AAY, AAY-AAY-AGY-AAY-AGY, AAY-AAY-AAY-AAY-AAY-AGY, AGY-AAY-AAY-AAY-AAY-AAY, AAY-AGY-AAY-AAY-AAY-AAY, AAY-AAY-AGY-AAY-AAY-AAY, AAY-AAY-AAY-AGY-AAY-AAY, AAY-AAY-AAY-AAY-AGY-AAY, AAY-AAY-AAY-AAY-AGY-AGY, AGY-AGY-AAY-AAY-AAY-AAY, AGY-AAY-AGY-AAY-AAY-AAY, AGY-AAY-AAY-AGY-AAY-AAY, AGY-AAY-AAY-AAY-AGY-AAY, AGY-AAY-AAY-AAY-AAY-AGY, AAY-AGY-AGY-AAY-AAY-AAY, AAY-AGY-AAY-AGY-AAY-AAY, AAY-AGY-AAY-AAY-AGY-AAY, AAY-AGY-AAY-AAY-AAY-AGY, AAY-AAY-AGY-AGY-AAY-AAY, AAY-AAY-AGY-AAY-AGY-AAY, AAY-AAY-AGY-AAY-AAY-AGY, AAY-AAY-AAY-AGY-AGY-AAY, AAY-AAY-AAY-AGY-AAY-AGY, AAY-AAY-AAY-AAY-AGY-AGY-AGY, AGY-AGY-AGY-AAY-AAY-AAY-AAY, AGY-AAY-AGY-AGY-AAY-AAY-AAY, AGY-AAY-AGY-AAY-AGY- |

TABLE 7-continued

| (SEQ ID NOS: 2482-4747, respectively, in order of appearance) |
|---|
| AAY-AAY, AGY-AAY-AGY-AAY-AAY-AGY-AAY, AGY-AAY-AGY-AAY-AAY-AAY-AGY, AGY-AAY-AAY-AGY-AGY-AAY-AAY, AGY-AAY-AAY-AGY-AAY-AGY-AAY, AGY-AAY-AAY-AGY-AAY-AAY-AGY, AGY-AAY-AAY-AAY-AGY-AAY-AGY, AGY-AAY-AAY-AAY-AGY-AGY-AAY, AGY-AAY-AAY-AAY-AAY-AGY-AGY, AGY-AGY-AAY-AGY-AAY-AAY-AAY, AGY-AGY-AAY-AAY-AGY-AAY-AAY, AGY-AGY-AAY-AAY-AAY-AGY-AAY, AGY-AGY-AAY-AAY-AAY-AAY-AGY, AAY-AGY-AGY-AGY-AAY-AAY-AAY, AAY-AGY-AGY-AAY-AGY-AAY-AAY, AAY-AGY-AGY-AAY-AAY-AGY-AAY, AAY-AGY-AGY-AAY-AAY-AAY-AGY, AAY-AGY-AAY-AGY-AGY-AAY-AAY, AAY-AGY-AAY-AAY-AGY-AGY-AAY, AAY-AGY-AAY-AAY-AAY-AGY-AGY, AAY-AGY-AAY-AGY-AAY-AGY-AAY, AAY-AGY-AAY-AGY-AAY-AAY-AGY, AAY-AGY-AAY-AAY-AGY-AAY-AGY, AAY-AAY-AGY-AGY-AGY-AAY-AAY, AAY-AAY-AGY-AGY-AAY-AGY-AAY, AAY-AAY-AGY-AGY-AAY-AAY-AGY, AAY-AAY-AGY-AAY-AGY-AGY-AAY, AAY-AAY-AGY-AAY-AGY-AAY-AGY, AAY-AAY-AGY-AAY-AAY-AGY-AGY, AAY-AAY-AAY-AGY-AGY-AGY-AAY, AAY-AAY-AAY-AGY-AGY-AAY-AGY, AAY-AAY-AAY-AGY-AAY-AGY-AGY, AAY-AAY-AAY-AAY-AAY-AGY-AGY, AGY-AGY-AAY-AAY-AAY-AAY-AAY, AGY-AAY-AGY-AAY-AAY-AAY-AAY, AGY-AAY-AAY-AGY-AAY-AAY-AAY, AGY-AAY-AAY-AAY-AGY-AAY-AAY, AGY-AAY-AAY-AAY-AAY-AGY-AAY, AGY-AAY-AAY-AAY-AAY-AAY-AGY, AAY-AGY-AGY-AAY-AAY-AAY-AAY, AAY-AGY-AAY-AGY-AAY-AAY-AAY, AAY-AGY-AAY-AAY-AGY-AAY-AAY, AAY-AGY-AAY-AAY-AAY-AGY-AAY, AAY-AGY-AAY-AAY-AAY-AAY-AGY, AAY-AAY-AGY-AGY-AAY-AAY-AAY, AAY-AAY-AGY-AAY-AGY-AAY-AAY, AAY-AAY-AGY-AAY-AAY-AGY-AAY, AAY-AAY-AGY-AAY-AAY-AAY-AGY, AAY-AAY-AAY-AGY-AGY-AAY-AAY, AAY-AAY-AAY-AGY-AAY-AGY-AAY, AAY-AAY-AAY-AGY-AAY-AAY-AGY, AAY-AAY-AAY-AAY-AGY-AGY-AAY, AAY-AAY-AAY-AAY-AGY-AAY-AGY-AAY-AAY-AAY-AAY-AAY-AAY-AGY, AGY-AAY-AAY-AAY-AAY-AAY-AAY, AAY-AGY-AAY-AAY-AAY-AAY-AAY, AAY-AAY-AGY-AAY-AAY-AAY-AAY, AAY-AAY-AAY-AGY-AAY-AAY-AAY, AAY-AAY-AAY-AAY-AGY-AAY-AAY, AAY-AAY-AAY-AAY-AAY-AGY-AAY |
| Oligonucleotides of peptide motifs containing 3-7 amino acid residues with N(Asparagine) as the major constituent and Q(Glutamine) as the minor constituent |
| AAY-AAY-CAR, CAR-AAY-AAY, AAY-CAR-AAY, AAY-AAY-AAY-CAR, CAR-AAY-AAY-AAY, AAY-CAR-AAY-AAY, AAY-AAY-CAR-AAY, AAY-AAY-AAY-AAY-CAR, CAR-AAY-AAY-AAY-AAY, AAY-CAR-AAY-AAY-AAY, AAY-AAY-CAR-AAY-AAY, AAY-AAY-AAY-CAR-AAY, AAY-AAY-AAY-CAR-CAR, CAR-CAR-AAY-AAY-AAY, CAR-AAY-CAR-AAY-AAY, CAR-AAY-AAY-CAR-AAY, CAR-AAY-AAY-AAY-CAR, AAY-CAR-CAR-AAY-AAY, AAY-CAR-AAY-CAR-AAY, AAY-CAR-AAY-AAY-CAR, AAY-AAY-CAR-CAR-AAY, AAY-AAY-CAR- |

TABLE 7-continued

| (SEQ ID NOS: 2482-4747, respectively, in order of appearance) |
|---|

AAY-CAR, AAY-AAY-AAY-AAY-AAY-CAR, CAR-AAY-AAY-AAY-AAY-AAY, AAY-CAR-AAY-AAY-AAY-AAY, AAY-AAY-CAR-AAY-AAY-AAY, AAY-AAY-AAY-CAR-AAY-AAY, AAY-AAY-AAY-AAY-CAR-AAY, AAY-AAY-AAY-AAY-CAR-CAR, CAR-CAR-AAY-AAY-AAY-AAY, CAR-AAY-CAR-AAY-AAY-AAY, CAR-AAY-AAY-CAR-AAY-AAY, CAR-AAY-AAY-AAY-CAR-AAY, CAR-AAY-AAY-AAY-AAY-CAR, AAY-CAR-CAR-AAY-AAY-AAY, AAY-CAR-AAY-CAR-AAY-AAY, AAY-CAR-AAY-AAY-CAR-AAY, AAY-CAR-AAY-AAY-AAY-CAR, AAY-AAY-CAR-CAR-AAY-AAY, AAY-AAY-CAR-AAY-CAR-AAY, AAY-AAY-CAR-AAY-AAY-CAR, AAY-AAY-AAY-CAR-CAR-AAY, AAY-AAY-AAY-CAR-AAY-CAR, AAY-AAY-AAY-AAY-CAR-CAR-CAR, CAR-CAR-CAR-AAY-AAY-AAY-AAY, CAR-AAY-CAR-CAR-AAY-AAY-AAY, CAR-AAY-CAR-AAY-CAR-AAY-AAY, CAR-AAY-CAR-AAY-AAY-CAR-AAY, CAR-AAY-CAR-AAY-AAY-AAY-CAR, CAR-AAY-AAY-CAR-CAR-AAY-AAY, CAR-AAY-AAY-CAR-AAY-CAR-AAY, CAR-AAY-AAY-CAR-AAY-AAY-CAR, CAR-AAY-AAY-AAY-CAR-AAY-CAR, CAR-AAY-AAY-AAY-CAR-CAR-AAY, CAR-AAY-AAY-AAY-AAY-CAR-CAR, CAR-CAR-AAY-CAR-AAY-AAY-AAY, CAR-CAR-AAY-AAY-CAR-AAY-AAY, CAR-CAR-AAY-AAY-AAY-CAR-AAY, CAR-CAR-AAY-AAY-AAY-AAY-CAR, AAY-CAR-CAR-CAR-AAY-AAY-AAY, AAY-CAR-CAR-AAY-CAR-AAY-AAY, AAY-CAR-CAR-AAY-AAY-CAR-AAY, AAY-CAR-CAR-AAY-AAY-AAY-CAR, AAY-CAR-AAY-CAR-CAR-AAY-AAY, AAY-CAR-AAY-AAY-CAR-CAR-AAY, AAY-CAR-AAY-AAY-AAY-CAR-CAR, AAY-CAR-AAY-CAR-AAY-CAR-AAY, AAY-CAR-AAY-CAR-AAY-AAY-CAR, AAY-CAR-AAY-AAY-CAR-AAY-CAR, AAY-AAY-CAR-CAR-CAR-AAY-AAY, AAY-AAY-CAR-CAR-AAY-CAR-AAY, AAY-AAY-CAR-CAR-AAY-AAY-CAR, AAY-AAY-CAR-AAY-CAR-CAR-AAY, AAY-AAY-CAR-AAY-CAR-AAY-CAR, AAY-AAY-CAR-AAY-AAY-CAR-CAR, AAY-AAY-AAY-CAR-CAR-CAR-AAY, AAY-AAY-AAY-CAR-CAR-AAY-CAR, AAY-AAY-AAY-CAR-AAY-CAR-CAR, AAY-AAY-AAY-AAY-AAY-CAR-CAR, CAR-CAR-AAY-AAY-AAY-AAY-AAY, CAR-AAY-CAR-AAY-AAY-AAY-AAY, CAR-AAY-AAY-CAR-AAY-AAY-AAY, CAR-AAY-AAY-AAY-CAR-AAY-AAY, CAR-AAY-AAY-AAY-AAY-CAR-AAY, CAR-AAY-AAY-AAY-AAY-AAY-CAR, AAY-CAR-CAR-AAY-AAY-AAY-AAY, AAY-CAR-AAY-CAR-AAY-AAY-AAY, AAY-CAR-AAY-AAY-CAR-AAY-AAY, AAY-CAR-AAY-AAY-AAY-CAR-AAY, AAY-CAR-AAY-AAY-AAY-AAY-CAR, AAY-AAY-CAR-CAR-AAY-AAY-AAY, AAY-AAY-CAR-AAY-CAR-AAY-AAY, AAY-AAY-CAR-AAY-AAY-CAR-AAY, AAY-AAY-CAR-AAY-AAY-AAY-CAR, AAY-AAY-AAY-CAR-CAR-AAY-AAY, AAY-AAY-AAY-CAR-AAY-CAR-AAY, AAY-AAY-AAY-CAR-AAY-AAY-CAR, AAY-AAY-AAY-AAY-CAR-CAR-AAY, AAY-AAY-AAY-AAY-CAR-AAY-CAR-AAY-AAY-AAY-AAY-AAY-AAY-CAR, CAR-AAY-AAY-AAY-AAY-

TABLE 7-continued

| (SEQ ID NOS: 2482-4747, respectively, in order of appearance) |
|---|
| AAY-AAY, AAY-CAR-AAY-AAY-AAY-AAY-AAY, AAY-AAY-CAR-AAY-AAY-AAY-AAY, AAY-AAY-AAY-CAR-AAY-AAY-AAY, AAY-AAY-AAY-AAY-CAR-AAY-AAY, AAY-AAY-AAY-AAY-AAY-CAR-AAY |
| Oligonucleotides of peptide motifs containing 3-7 amino acid residues with N(Asparagine) as the major constituent and E(Glutamic Acid) as the minor constituent |
| AAY-AAY-GAR, GAR-AAY-AAY, AAY-GAR-AAY, AAY-AAY-AAY-GAR, GAR-AAY-AAY-AAY, AAY-GAR-AAY-AAY, AAY-AAY-GAR-AAY, AAY-AAY-AAY-AAY-GAR, GAR-AAY-AAY-AAY-AAY, AAY-GAR-AAY-AAY-AAY, AAY-AAY-GAR-AAY-AAY, AAY-AAY-AAY-GAR-AAY, AAY-AAY-AAY-GAR-GAR, GAR-GAR-AAY-AAY-AAY, GAR-AAY-GAR-AAY-AAY, GAR-AAY-AAY-GAR-AAY, GAR-AAY-AAY-AAY-GAR, AAY-GAR-GAR-AAY-AAY, AAY-GAR-AAY-GAR-AAY, AAY-GAR-AAY-AAY-GAR, AAY-AAY-GAR-GAR-AAY, AAY-AAY-GAR-AAY-GAR, AAY-AAY-AAY-AAY-AAY-GAR, GAR-AAY-AAY-AAY-AAY-AAY, AAY-GAR-AAY-AAY-AAY-AAY, AAY-AAY-GAR-AAY-AAY-AAY, AAY-AAY-AAY-GAR-AAY-AAY, AAY-AAY-AAY-AAY-GAR-AAY, AAY-AAY-AAY-AAY-GAR-GAR, GAR-GAR-AAY-AAY-AAY-AAY, GAR-AAY-GAR-AAY-AAY-AAY, GAR-AAY-AAY-GAR-AAY-AAY, GAR-AAY-AAY-AAY-GAR-AAY, GAR-AAY-AAY-AAY-AAY-GAR, AAY-GAR-GAR-AAY-AAY-AAY, AAY-GAR-AAY-GAR-AAY-AAY, AAY-GAR-AAY-AAY-GAR-AAY, AAY-GAR-AAY-AAY-AAY-GAR, AAY-AAY-GAR-GAR-AAY-AAY, AAY-AAY-GAR-AAY-GAR-AAY, AAY-AAY-GAR-AAY-AAY-GAR, AAY-AAY-AAY-GAR-GAR-AAY, AAY-AAY-AAY-GAR-AAY-GAR, AAY-AAY-AAY-AAY-GAR-GAR-GAR, GAR-GAR-GAR-AAY-AAY-AAY-AAY, GAR-AAY-GAR-GAR-AAY-AAY-AAY, GAR-AAY-GAR-AAY-GAR-AAY-AAY, GAR-AAY-GAR-AAY-AAY-GAR-AAY, GAR-AAY-GAR-AAY-AAY-AAY-GAR, GAR-AAY-AAY-GAR-GAR-AAY-AAY, GAR-AAY-AAY-GAR-AAY-GAR-AAY, GAR-AAY-AAY-GAR-AAY-AAY-GAR, GAR-AAY-AAY-AAY-GAR-AAY-GAR, GAR-AAY-AAY-AAY-GAR-GAR-AAY, GAR-AAY-AAY-AAY-AAY-GAR-GAR, GAR-GAR-AAY-GAR-AAY-AAY-AAY, GAR-GAR-AAY-AAY-GAR-AAY-AAY, GAR-GAR-AAY-AAY-AAY-GAR-AAY, GAR-GAR-AAY-AAY-AAY-AAY-GAR, AAY-GAR-GAR-GAR-AAY-AAY-AAY, AAY-GAR-GAR-AAY-GAR-AAY-AAY, AAY-GAR-GAR-AAY-AAY-GAR-AAY, AAY-GAR-GAR-AAY-AAY-AAY-GAR, AAY-GAR-AAY-GAR-GAR-AAY-AAY, AAY-GAR-AAY-AAY-GAR-GAR-AAY, AAY-GAR-AAY-AAY-AAY-GAR-GAR, AAY-GAR-AAY-GAR-AAY-GAR-AAY, AAY-GAR-AAY-GAR-AAY-AAY-GAR, AAY-GAR-AAY-AAY-GAR-AAY-GAR, AAY-AAY-GAR-GAR-GAR-AAY-AAY, AAY-AAY-GAR-GAR-AAY-GAR-AAY, AAY-AAY-GAR-GAR-AAY-AAY-GAR, AAY-AAY-GAR-AAY-GAR-GAR-AAY, AAY-AAY-GAR-AAY-GAR-AAY-GAR, AAY-AAY-GAR-AAY-AAY-GAR-GAR, AAY-AAY-AAY-GAR-GAR-GAR-AAY, AAY-AAY-AAY-GAR-GAR-AAY-GAR, AAY-AAY-AAY-GAR-AAY-GAR-GAR, AAY-AAY-AAY-AAY-AAY- |

TABLE 7-continued

| (SEQ ID NOS: 2482-4747, respectively, in order of appearance) |
|---|
| GAR-GAR, GAR-GAR-AAY-AAY-AAY-AAY-AAY, GAR-AAY-GAR-AAY-AAY-AAY-AAY, GAR-AAY-AAY-GAR-AAY-AAY-AAY, GAR-AAY-AAY-AAY-GAR-AAY-AAY, GAR-AAY-AAY-AAY-AAY-GAR-AAY, GAR-AAY-AAY-AAY-AAY-AAY-GAR, AAY-GAR-GAR-AAY-AAY-AAY-AAY, AAY-GAR-AAY-GAR-AAY-AAY-AAY, AAY-GAR-AAY-AAY-GAR-AAY-AAY, AAY-GAR-AAY-AAY-AAY-GAR-AAY, AAY-GAR-AAY-AAY-AAY-AAY-GAR, AAY-AAY-GAR-GAR-AAY-AAY-AAY, AAY-AAY-GAR-AAY-GAR-AAY-AAY, AAY-AAY-GAR-AAY-AAY-GAR-AAY, AAY-AAY-GAR-AAY-AAY-AAY-GAR, AAY-AAY-AAY-GAR-GAR-AAY-AAY, AAY-AAY-AAY-GAR-AAY-GAR-AAY, AAY-AAY-AAY-GAR-AAY-AAY-GAR, AAY-AAY-AAY-AAY-GAR-GAR-AAY, AAY-AAY-AAY-AAY-GAR-AAY-GAR-AAY-AAY-AAY-AAY-AAY-AAY-GAR, GAR-AAY-AAY-AAY-AAY-AAY-AAY, AAY-GAR-AAY-AAY-AAY-AAY-AAY, AAY-AAY-GAR-AAY-AAY-AAY-AAY, AAY-AAY-AAY-GAR-AAY-AAY-AAY, AAY-AAY-AAY-AAY-GAR-AAY-AAY, AAY-AAY-AAY-AAY-AAY-GAR-AAY |
| Oligonucleotides of peptide motifs containing 3-7 amino acid residues with N(Asparagine) as the major constituent and H(Histidine) as the minor constituent |
| AAY-AAY-CAY, CAY-AAY-AAY, AAY-CAY-AAY, AAY-AAY-AAY-CAY, CAY-AAY-AAY-AAY, AAY-CAY-AAY-AAY, AAY-AAY-CAY-AAY, AAY-AAY-AAY-AAY-CAY, CAY-AAY-AAY-AAY-AAY, AAY-CAY-AAY-AAY-AAY, AAY-AAY-CAY-AAY-AAY, AAY-AAY-AAY-CAY-AAY, AAY-AAY-AAY-CAY-CAY, CAY-CAY-AAY-AAY-AAY, CAY-AAY-CAY-AAY-AAY, CAY-AAY-AAY-CAY-AAY, CAY-AAY-AAY-AAY-CAY, AAY-CAY-CAY-AAY-AAY, AAY-CAY-AAY-CAY-AAY, AAY-CAY-AAY-AAY-CAY, AAY-AAY-CAY-CAY-AAY, AAY-AAY-CAY-AAY-CAY, AAY-AAY-AAY-AAY-AAY-CAY, CAY-AAY-AAY-AAY-AAY-AAY, AAY-CAY-AAY-AAY-AAY-AAY, AAY-AAY-CAY-AAY-AAY-AAY, AAY-AAY-AAY-CAY-AAY-AAY, AAY-AAY-AAY-AAY-CAY-AAY, AAY-AAY-AAY-AAY-CAY-CAY, CAY-CAY-AAY-AAY-AAY-AAY, CAY-AAY-CAY-AAY-AAY-AAY, CAY-AAY-AAY-CAY-AAY-AAY, CAY-AAY-AAY-AAY-CAY-AAY, CAY-AAY-AAY-AAY-AAY-CAY, AAY-CAY-CAY-AAY-AAY-AAY, AAY-CAY-AAY-CAY-AAY-AAY, AAY-CAY-AAY-AAY-CAY-AAY, AAY-CAY-AAY-AAY-AAY-CAY, AAY-AAY-CAY-CAY-AAY-AAY, AAY-AAY-CAY-AAY-CAY-AAY, AAY-AAY-CAY-AAY-AAY-CAY, AAY-AAY-AAY-CAY-CAY-AAY, AAY-AAY-AAY-CAY-AAY-CAY, AAY-AAY-AAY-AAY-CAY-CAY-CAY, CAY-CAY-CAY-AAY-AAY-AAY-AAY, CAY-AAY-CAY-CAY-AAY-AAY-AAY, CAY-AAY-CAY-AAY-CAY-AAY-AAY, CAY-AAY-CAY-AAY-AAY-CAY-AAY, CAY-AAY-CAY-AAY-AAY-AAY-CAY, CAY-AAY-AAY-CAY-CAY-AAY-AAY, CAY-AAY-AAY-CAY-AAY-CAY-AAY, CAY-AAY-AAY-CAY-AAY-AAY-CAY, CAY-AAY-AAY-AAY-CAY-AAY-CAY, CAY-AAY-AAY-AAY-CAY-CAY-AAY, CAY-AAY-AAY-AAY-AAY- |

TABLE 7-continued

| (SEQ ID NOS: 2482-4747, respectively, in order of appearance) |
|---|
| CAY-CAY, CAY-CAY-AAY-CAY-AAY-AAY-AAY, CAY-CAY-AAY-AAY-CAY-AAY-AAY, CAY-CAY-AAY-AAY-AAY-CAY-AAY, CAY-CAY-AAY-AAY-AAY-AAY-CAY, AAY-CAY-CAY-CAY-AAY-AAY-AAY, AAY-CAY-CAY-AAY-CAY-AAY-AAY, AAY-CAY-CAY-AAY-AAY-CAY-AAY, AAY-CAY-CAY-AAY-AAY-AAY-CAY, AAY-CAY-AAY-CAY-CAY-AAY-AAY, AAY-CAY-AAY-AAY-CAY-CAY-AAY, AAY-CAY-AAY-AAY-AAY-CAY-CAY, AAY-CAY-AAY-CAY-AAY-CAY-AAY, AAY-CAY-AAY-CAY-AAY-AAY-CAY, AAY-CAY-AAY-AAY-CAY-AAY-CAY, AAY-AAY-CAY-CAY-CAY-AAY-AAY, AAY-AAY-CAY-CAY-AAY-CAY-AAY, AAY-AAY-CAY-CAY-AAY-AAY-CAY, AAY-AAY-CAY-AAY-CAY-CAY-AAY, AAY-AAY-CAY-AAY-CAY-AAY-CAY, AAY-AAY-CAY-AAY-AAY-CAY-CAY, AAY-AAY-AAY-CAY-CAY-CAY-AAY, AAY-AAY-AAY-CAY-CAY-AAY-CAY, AAY-AAY-AAY-CAY-AAY-CAY-CAY, AAY-AAY-AAY-AAY-AAY-CAY-CAY, CAY-CAY-AAY-AAY-AAY-AAY-AAY, CAY-AAY-CAY-AAY-AAY-AAY-AAY, CAY-AAY-AAY-CAY-AAY-AAY-AAY, CAY-AAY-AAY-AAY-CAY-AAY-AAY, CAY-AAY-AAY-AAY-AAY-CAY-AAY, CAY-AAY-AAY-AAY-AAY-AAY-CAY, AAY-CAY-CAY-AAY-AAY-AAY-AAY, AAY-CAY-AAY-CAY-AAY-AAY-AAY, AAY-CAY-AAY-AAY-CAY-AAY-AAY, AAY-CAY-AAY-AAY-AAY-CAY-AAY, AAY-CAY-AAY-AAY-AAY-AAY-CAY, AAY-AAY-CAY-CAY-AAY-AAY-AAY, AAY-AAY-CAY-AAY-CAY-AAY-AAY, AAY-AAY-CAY-AAY-AAY-CAY-AAY, AAY-AAY-CAY-AAY-AAY-AAY-CAY, AAY-AAY-AAY-CAY-CAY-AAY-AAY, AAY-AAY-AAY-CAY-AAY-CAY-AAY, AAY-AAY-AAY-CAY-AAY-AAY-CAY, AAY-AAY-AAY-AAY-CAY-CAY-AAY, AAY-AAY-AAY-AAY-CAY-AAY-CAY-AAY-AAY-AAY-AAY-AAY-AAY-CAY, CAY-AAY-AAY-AAY-AAY-AAY-AAY, AAY-CAY-AAY-AAY-AAY-AAY-AAY, AAY-AAY-CAY-AAY-AAY-AAY-AAY, AAY-AAY-AAY-CAY-AAY-AAY-AAY, AAY-AAY-AAY-AAY-CAY-AAY-AAY, AAY-AAY-AAY-AAY-AAY-CAY-AAY |
| Oligonucleotides of peptide motifs containing 3-7 amino acid residues with N(Asparagine) as the major constituent and D(Aspartic Acid) as the minor constituent |
| AAY-AAY-GAY, GAY-AAY-AAY, AAY-GAY-AAY, AAY-AAY-AAY-GAY, GAY-AAY-AAY-AAY, AAY-GAY-AAY-AAY, AAY-AAY-GAY-AAY, AAY-AAY-AAY-AAY-GAY, GAY-AAY-AAY-AAY-AAY, AAY-GAY-AAY-AAY-AAY, AAY-AAY-GAY-AAY-AAY, AAY-AAY-AAY-GAY-AAY, AAY-AAY-AAY-GAY-GAY, GAY-GAY-AAY-AAY-AAY, GAY-AAY-GAY-AAY-AAY, GAY-AAY-AAY-GAY-AAY, GAY-AAY-AAY-AAY-GAY, AAY-GAY-GAY-AAY-AAY, AAY-GAY-AAY-GAY-AAY, AAY-GAY-AAY-AAY-GAY, AAY-AAY-GAY-GAY-AAY, AAY-AAY-GAY-AAY-GAY, AAY-AAY-AAY-AAY-AAY-GAY, GAY-AAY-AAY-AAY-AAY-AAY, AAY-GAY-AAY-AAY-AAY-AAY, AAY-AAY-GAY-AAY-AAY-AAY, AAY-AAY-AAY-GAY-AAY-AAY, AAY-AAY-AAY-AAY-GAY-AAY, AAY-AAY-AAY-AAY-GAY-GAY, GAY-GAY-AAY-AAY-AAY-AAY, GAY-AAY-GAY-AAY-AAY-AAY, |

TABLE 7-continued

| (SEQ ID NOS: 2482-4747, respectively, in order of appearance) |
|---|

GAY-AAY-AAY-GAY-AAY-AAY, GAY-AAY-AAY-AAY-GAY-AAY, GAY-AAY-AAY-AAY-AAY-GAY, AAY-GAY-GAY-AAY-AAY-AAY, AAY-GAY-AAY-GAY-AAY-AAY, AAY-GAY-AAY-AAY-GAY-AAY, AAY-GAY-AAY-AAY-AAY-GAY, AAY-AAY-GAY-GAY-AAY-AAY, AAY-AAY-GAY-AAY-GAY-AAY, AAY-AAY-GAY-AAY-AAY-GAY, AAY-AAY-AAY-GAY-GAY-AAY, AAY-AAY-AAY-GAY-AAY-GAY, AAY-AAY-AAY-AAY-GAY-GAY-GAY, GAY-GAY-GAY-AAY-AAY-AAY-AAY, GAY-AAY-GAY-GAY-AAY-AAY-AAY, GAY-AAY-GAY-AAY-GAY-AAY-AAY, GAY-AAY-GAY-AAY-AAY-GAY-AAY, GAY-AAY-GAY-AAY-AAY-AAY-GAY, GAY-AAY-AAY-GAY-GAY-AAY-AAY, GAY-AAY-AAY-GAY-AAY-GAY-AAY, GAY-AAY-AAY-GAY-AAY-AAY-GAY, GAY-AAY-AAY-AAY-GAY-AAY-GAY, GAY-AAY-AAY-AAY-GAY-GAY-AAY, GAY-AAY-AAY-AAY-AAY-GAY-GAY, GAY-GAY-AAY-GAY-AAY-AAY-AAY, GAY-GAY-AAY-AAY-GAY-AAY-AAY, GAY-GAY-AAY-AAY-AAY-GAY-AAY, GAY-GAY-AAY-AAY-AAY-AAY-GAY, AAY-GAY-GAY-GAY-AAY-AAY-AAY, AAY-GAY-GAY-AAY-GAY-AAY-AAY, AAY-GAY-GAY-AAY-AAY-GAY-AAY, AAY-GAY-GAY-AAY-AAY-AAY-GAY, AAY-GAY-AAY-GAY-GAY-AAY-AAY, AAY-GAY-AAY-AAY-GAY-GAY-AAY, AAY-GAY-AAY-AAY-AAY-GAY-GAY, AAY-GAY-AAY-GAY-AAY-GAY-AAY, AAY-GAY-AAY-GAY-AAY-AAY-GAY, AAY-GAY-AAY-AAY-GAY-AAY-GAY, AAY-AAY-GAY-GAY-GAY-AAY-AAY, AAY-AAY-GAY-GAY-AAY-GAY-AAY, AAY-AAY-GAY-GAY-AAY-AAY-GAY, AAY-AAY-GAY-AAY-GAY-GAY-AAY, AAY-AAY-GAY-AAY-GAY-AAY-GAY, AAY-AAY-GAY-AAY-AAY-GAY-GAY, AAY-AAY-AAY-GAY-GAY-GAY-AAY, AAY-AAY-AAY-GAY-GAY-AAY-GAY, AAY-AAY-AAY-GAY-AAY-GAY-GAY, AAY-AAY-AAY-AAY-AAY-GAY-GAY, GAY-GAY-AAY-AAY-AAY-AAY-AAY, GAY-AAY-GAY-AAY-AAY-AAY-AAY, GAY-AAY-AAY-GAY-AAY-AAY-AAY, GAY-AAY-AAY-AAY-GAY-AAY-AAY, GAY-AAY-AAY-AAY-AAY-GAY-AAY, GAY-AAY-AAY-AAY-AAY-AAY-GAY, AAY-GAY-GAY-AAY-AAY-AAY-AAY, AAY-GAY-AAY-GAY-AAY-AAY-AAY, AAY-GAY-AAY-AAY-GAY-AAY-AAY, AAY-GAY-AAY-AAY-AAY-GAY-AAY, AAY-GAY-AAY-AAY-AAY-AAY-GAY, AAY-AAY-GAY-GAY-AAY-AAY-AAY, AAY-AAY-GAY-AAY-GAY-AAY-AAY, AAY-AAY-GAY-AAY-AAY-GAY-AAY, AAY-AAY-GAY-AAY-AAY-AAY-GAY, AAY-AAY-AAY-GAY-GAY-AAY-AAY, AAY-AAY-AAY-GAY-AAY-GAY-AAY, AAY-AAY-AAY-GAY-AAY-AAY-GAY, AAY-AAY-AAY-AAY-GAY-GAY-AAY, AAY-AAY-AAY-AAY-GAY-AAY-GAY-AAY-AAY-AAY-AAY-AAY-AAY-GAY, GAY-AAY-AAY-AAY-AAY-AAY-AAY, AAY-GAY-AAY-AAY-AAY-AAY-AAY, AAY-AAY-GAY-AAY-AAY-AAY-AAY, AAY-AAY-AAY-GAY-AAY-AAY-AAY, AAY-AAY-AAY-AAY-GAY-AAY-AAY, AAY-AAY-AAY-AAY-AAY-GAY-AAY

TABLE 7-continued

| (SEQ ID NOS: 2482-4747, respectively, in order of appearance) |
|---|
| Oligonucleotides of peptide motifs containing 3-7 amino acide residues with G (glycine) as the major constituent and T(Threonine) as the minor constituent |
| GGN-GGN-ACN, ACN-GGN-GGN, GGN-ACN-GGN, GGN-GGN-GGN-ACN, ACN-GGN-GGN-GGN, GGN-ACN-GGN-GGN, GGN-GGN-ACN-GGN, GGN-GGN-GGN-GGN-ACN, ACN-GGN-GGN-GGN-GGN, GGN-ACN-GGN-GGN-GGN, GGN-GGN-ACN-GGN-GGN, GGN-GGN-GGN-ACN-GGN, GGN-GGN-GGN-ACN-ACN, ACN-ACN-GGN-GGN-GGN, ACN-GGN-ACN-GGN-GGN, ACN-GGN-GGN-ACN-GGN, ACN-GGN-GGN-GGN-ACN, GGN-ACN-ACN-GGN-GGN, GGN-ACN-GGN-ACN-GGN, GGN-ACN-GGN-GGN-ACN, GGN-GGN-ACN-ACN-GGN, GGN-GGN-ACN-GGN-ACN, GGN-GGN-GGN-GGN-GGN-ACN, ACN-GGN-GGN-GGN-GGN-GGN, GGN-ACN-GGN-GGN-GGN-GGN, GGN-GGN-ACN-GGN-GGN-GGN, GGN-GGN-GGN-ACN-GGN-GGN, GGN-GGN-GGN-GGN-ACN-GGN, GGN-GGN-GGN-GGN-ACN-ACN, ACN-ACN-GGN-GGN-GGN-GGN, ACN-GGN-ACN-GGN-GGN-GGN, ACN-GGN-GGN-ACN-GGN-GGN, ACN-GGN-GGN-GGN-ACN-GGN, ACN-GGN-GGN-GGN-GGN-ACN, GGN-ACN-ACN-GGN-GGN-GGN, GGN-ACN-GGN-ACN-GGN-GGN, GGN-ACN-GGN-GGN-ACN-GGN, GGN-ACN-GGN-GGN-GGN-ACN, GGN-GGN-ACN-ACN-GGN-GGN, GGN-GGN-ACN-GGN-ACN-GGN, GGN-GGN-ACN-GGN-GGN-ACN, GGN-GGN-GGN-ACN-ACN-GGN, GGN-GGN-GGN-ACN-GGN-ACN, GGN-GGN-GGN-GGN-ACN-ACN-ACN, ACN-ACN-ACN-GGN-GGN-GGN-GGN, ACN-GGN-ACN-ACN-GGN-GGN-GGN, ACN-GGN-ACN-GGN-ACN-GGN-GGN, ACN-GGN-ACN-GGN-GGN-ACN-GGN, ACN-GGN-ACN-GGN-GGN-GGN-ACN, ACN-GGN-GGN-ACN-ACN-GGN-GGN, ACN-GGN-GGN-ACN-GGN-ACN-GGN, ACN-GGN-GGN-ACN-GGN-GGN-ACN, ACN-GGN-GGN-GGN-ACN-GGN-ACN, ACN-GGN-GGN-GGN-ACN-ACN-GGN, ACN-GGN-GGN-GGN-GGN-ACN-ACN, ACN-ACN-GGN-ACN-GGN-GGN-GGN, ACN-ACN-GGN-GGN-ACN-GGN-GGN, ACN-ACN-GGN-GGN-GGN-ACN-GGN, ACN-ACN-GGN-GGN-GGN-GGN-ACN, GGN-ACN-ACN-ACN-GGN-GGN-GGN, GGN-ACN-ACN-GGN-ACN-GGN-GGN, GGN-ACN-ACN-GGN-GGN-ACN-GGN, GGN-ACN-ACN-GGN-GGN-GGN-ACN, GGN-ACN-GGN-ACN-ACN-GGN-GGN, GGN-ACN-GGN-GGN-ACN-ACN-GGN, GGN-ACN-GGN-GGN-GGN-ACN-ACN, GGN-ACN-GGN-ACN-GGN-ACN-GGN, GGN-ACN-GGN-ACN-GGN-GGN-ACN, GGN-ACN-GGN-GGN-ACN-GGN-ACN, GGN-GGN-ACN-ACN-ACN-GGN-GGN, GGN-GGN-ACN-ACN-GGN-ACN-GGN, GGN-GGN-ACN-ACN-GGN-GGN-ACN, GGN-GGN-ACN-GGN-ACN-ACN-GGN, GGN-GGN-ACN-GGN-ACN-GGN-ACN, GGN-GGN-ACN-GGN-GGN-ACN-ACN, GGN-GGN-GGN-ACN-ACN-ACN-GGN, GGN-GGN-GGN-ACN-ACN-GGN-ACN, GGN-GGN-GGN-ACN-GGN-ACN-ACN, GGN-GGN-GGN-GGN-GGN-ACN-ACN, ACN-ACN-GGN-GGN-GGN-GGN-GGN, ACN-GGN-ACN-GGN-GGN-GGN-GGN, ACN-GGN-GGN-ACN-GGN-GGN-GGN, ACN-GGN-GGN-GGN-ACN-GGN-GGN, ACN-GGN-GGN-GGN-GGN-ACN-GGN, ACN-GGN-GGN-GGN-GGN- |

TABLE 7-continued (SEQ ID NOS: 2482-4747, respectively, in order of appearance)

GGN-ACN, GGN-ACN-ACN-GGN-GGN-GGN-GGN, GGN-ACN-GGN-ACN-GGN-GGN-GGN, GGN-ACN-GGN-GGN-ACN-GGN-GGN, GGN-ACN-GGN-GGN-GGN-ACN-GGN, GGN-ACN-GGN-GGN-GGN-GGN-ACN, GGN-GGN-ACN-ACN-GGN-GGN-GGN, GGN-GGN-ACN-GGN-ACN-GGN-GGN, GGN-GGN-ACN-GGN-GGN-ACN-GGN, GGN-GGN-ACN-GGN-GGN-GGN-ACN, GGN-GGN-GGN-ACN-ACN-GGN-GGN, GGN-GGN-GGN-ACN-GGN-ACN-GGN, GGN-GGN-GGN-ACN-GGN-GGN-ACN, GGN-GGN-GGN-GGN-ACN-ACN-GGN, GGN-GGN-GGN-GGN-ACN-GGN-ACN-GGN-GGN-GGN-GGN-GGN-GGN-ACN, ACN-GGN-GGN-GGN-GGN-GGN-GGN, GGN-ACN-GGN-GGN-GGN-GGN-GGN, GGN-GGN-ACN-GGN-GGN-GGN-GGN, GGN-GGN-GGN-ACN-GGN-GGN-GGN, GGN-GGN-GGN-GGN-ACN-GGN-GGN, GGN-GGN-GGN-GGN-GGN-ACN-GGN

Oligonucleotides of peptide motifs containing 3-7 amino acide residues with G(glycine) as the major constituent and A(Alanine) as the minor constituent GGN-GGN-GCN, GCN-GGN-GGN, GGN-GCN-GGN, GGN-GGN-GGN-GCN, GCN-GGN-GGN-GGN, GGN-GCN-GGN-GGN, GGN-GGN-GCN-GGN, GGN-GGN-GGN-GGN-GCN, GCN-GGN-GGN-GGN-GGN, GGN-GCN-GGN-GGN-GGN, GGN-GGN-GCN-GGN-GGN, GGN-GGN-GGN-GCN-GGN, GGN-GGN-GGN-GCN-GCN, GCN-GCN-GGN-GGN-GGN, GCN-GGN-GCN-GGN-GGN, GCN-GGN-GGN-GCN-GGN, GCN-GGN-GGN-GGN-GCN, GGN-GCN-GCN-GGN-GGN, GGN-GCN-GGN-GCN-GGN, GGN-GCN-GGN-GGN-GCN, GGN-GGN-GCN-GCN-GGN, GGN-GGN-GCN-GGN-GCN, GGN-GGN-GGN-GGN-GGN-GCN, GCN-GGN-GGN-GGN-GGN-GGN, GGN-GCN-GGN-GGN-GGN-GGN, GGN-GGN-GCN-GGN-GGN-GGN, GGN-GGN-GGN-GCN-GGN-GGN, GGN-GGN-GGN-GGN-GCN-GGN, GGN-GGN-GGN-GGN-GCN-GCN, GCN-GCN-GGN-GGN-GGN-GGN, GCN-GGN-GCN-GGN-GGN-GGN, GCN-GGN-GGN-GCN-GGN-GGN, GCN-GGN-GGN-GGN-GCN-GGN, GCN-GGN-GGN-GGN-GGN-GCN, GGN-GCN-GCN-GGN-GGN-GGN, GGN-GCN-GGN-GCN-GGN-GGN, GGN-GCN-GGN-GGN-GCN-GGN, GGN-GCN-GGN-GGN-GGN-GCN, GGN-GGN-GCN-GCN-GGN-GGN, GGN-GGN-GCN-GGN-GCN-GGN, GGN-GGN-GCN-GGN-GGN-GCN, GGN-GGN-GGN-GCN-GCN-GGN, GGN-GGN-GGN-GCN-GGN-GCN, GGN-GGN-GGN-GGN-GCN-GCN-GCN, GCN-GCN-GCN-GGN-GGN-GGN-GGN, GCN-GGN-GCN-GCN-GGN-GGN-GGN, GCN-GGN-GCN-GGN-GCN-GGN-GGN, GCN-GGN-GCN-GGN-GGN-GCN-GGN, GCN-GGN-GCN-GGN-GGN-GGN-GCN, GCN-GGN-GGN-GCN-GCN-GGN-GGN, GCN-GGN-GGN-GCN-GGN-GCN-GGN, GCN-GGN-GGN-GCN-GGN-GGN-GCN, GCN-GGN-GGN-GGN-GCN-GGN-GCN, GCN-GGN-GGN-GGN-GCN-GCN-GGN, GCN-GGN-GGN-GGN-GGN-GCN-GCN, GCN-GCN-GGN-GCN-GGN-GGN-GGN, GCN-GCN-GGN-GGN-GCN-GGN-GGN, GCN-GCN-GGN-GGN-GGN-GCN-GGN, GCN-GCN-GGN-GGN-GGN-GGN-GCN, GGN-GCN-GCN-GCN-GGN-GGN-GGN, GGN-GCN-GCN-GGN-GCN- TABLE 7-continued

| (SEQ ID NOS: 2482-4747, respectively, in order of appearance) |
|---|
| GGN-GGN, GGN-GCN-GCN-GGN-GGN-GCN-GGN, GGN-GCN-GCN-GGN-GGN-GGN-GCN, GGN-GCN-GGN-GCN-GCN-GGN-GGN, GGN-GCN-GGN-GGN-GCN-GCN-GGN, GGN-GCN-GGN-GGN-GGN-GCN-GCN, GGN-GCN-GGN-GCN-GGN-GCN-GGN, GGN-GCN-GGN-GCN-GGN-GGN-GCN, GGN-GCN-GGN-GGN-GCN-GGN-GCN, GGN-GGN-GCN-GCN-GCN-GGN-GGN, GGN-GGN-GCN-GCN-GGN-GCN-GGN, GGN-GGN-GCN-GCN-GGN-GGN-GCN, GGN-GGN-GCN-GGN-GCN-GCN-GGN, GGN-GGN-GCN-GGN-GCN-GGN-GCN, GGN-GGN-GCN-GGN-GGN-GCN-GCN, GGN-GGN-GGN-GCN-GCN-GCN-GGN, GGN-GGN-GGN-GCN-GCN-GGN-GCN, GGN-GGN-GGN-GCN-GGN-GCN-GCN, GGN-GGN-GGN-GGN-GGN-GCN-GCN, GCN-GCN-GGN-GGN-GGN-GGN-GGN, GCN-GGN-GCN-GGN-GGN-GGN-GGN, GCN-GGN-GGN-GCN-GGN-GGN-GGN, GCN-GGN-GGN-GGN-GCN-GGN-GGN, GCN-GGN-GGN-GGN-GGN-GCN-GGN, GCN-GGN-GGN-GGN-GGN-GGN-GCN, GGN-GCN-GCN-GGN-GGN-GGN-GGN, GGN-GCN-GGN-GCN-GGN-GGN-GGN, GGN-GCN-GGN-GGN-GCN-GGN-GGN, GGN-GCN-GGN-GGN-GGN-GCN-GGN, GGN-GCN-GGN-GGN-GGN-GGN-GCN, GGN-GGN-GCN-GCN-GGN-GGN-GGN, GGN-GGN-GCN-GGN-GCN-GGN-GGN, GGN-GGN-GCN-GGN-GGN-GCN-GGN, GGN-GGN-GCN-GGN-GGN-GGN-GCN, GGN-GGN-GGN-GCN-GCN-GGN-GGN, GGN-GGN-GGN-GCN-GGN-GCN-GGN, GGN-GGN-GGN-GCN-GGN-GGN-GCN, GGN-GGN-GGN-GGN-GCN-GCN-GGN, GGN-GGN-GGN-GGN-GCN-GGN-GCN-GGN-GGN-GGN-GGN-GGN-GCN, GCN-GGN-GGN-GGN-GGN-GGN-GGN, GGN-GCN-GGN-GGN-GGN-GGN-GGN, GGN-GGN-GCN-GGN-GGN-GGN-GGN, GGN-GGN-GGN-GCN-GGN-GGN-GGN, GGN-GGN-GGN-GGN-GCN-GGN-GGN, GGN-GGN-GGN-GGN-GGN-GCN-GGN |
| Oligonucleotides of peptide motifs containing 3-7 amino acide residues with G(glycine) as the major constituent and S(Serine) as the minor constituent |
| GGN-GGN-AGY, AGY-GGN-GGN, GGN-AGY-GGN, GGN-GGN-GGN-AGY, AGY-GGN-GGN-GGN, GGN-AGY-GGN-GGN, GGN-GGN-AGY-GGN, GGN-GGN-GGN-GGN-AGY, AGY-GGN-GGN-GGN-GGN, GGN-AGY-GGN-GGN-GGN, GGN-GGN-AGY-GGN-GGN, GGN-GGN-GGN-AGY-GGN, GGN-GGN-GGN-AGY-AGY, AGY-AGY-GGN-GGN-GGN, AGY-GGN-AGY-GGN-GGN, AGY-GGN-GGN-AGY-GGN, AGY-GGN-GGN-GGN-AGY, GGN-AGY-AGY-GGN-GGN, GGN-AGY-GGN-AGY-GGN, GGN-AGY-GGN-GGN-AGY, GGN-GGN-AGY-AGY-GGN, GGN-GGN-AGY-GGN-AGY, GGN-GGN-GGN-GGN-GGN-AGY, AGY-GGN-GGN-GGN-GGN-GGN, GGN-AGY-GGN-GGN-GGN-GGN, GGN-GGN-AGY-GGN-GGN-GGN, GGN-GGN-GGN-AGY-GGN-GGN, GGN-GGN-GGN-GGN-AGY-GGN, GGN-GGN-GGN-GGN-AGY-AGY, AGY-AGY-GGN-GGN-GGN-GGN, AGY-GGN-AGY-GGN-GGN-GGN, AGY-GGN-GGN-AGY-GGN-GGN, AGY-GGN-GGN-GGN-AGY-GGN, AGY-GGN-GGN-GGN-GGN-AGY, GGN-AGY-AGY-GGN-GGN-GGN, GGN-AGY-GGN-AGY-GGN-GGN, GGN-AGY-GGN-GGN-AGY-GGN, GGN-AGY-GGN-GGN-GGN-AGY, |

TABLE 7-continued

| (SEQ ID NOS: 2482-4747, respectively, in order of appearance) |
|---|
| GGN-GGN-AGY-AGY-GGN-GGN, GGN-GGN-AGY-GGN-AGY-GGN, GGN-GGN-AGY-GGN-GGN-AGY, GGN-GGN-GGN-AGY-AGY-GGN, GGN-GGN-GGN-AGY-GGN-AGY, GGN-GGN-GGN-GGN-AGY-AGY-AGY, AGY-AGY-AGY-GGN-GGN-GGN-GGN, AGY-GGN-AGY-AGY-GGN-GGN-GGN, AGY-GGN-AGY-GGN-AGY-GGN-GGN, AGY-GGN-AGY-GGN-GGN-AGY-GGN, AGY-GGN-AGY-GGN-GGN-GGN-AGY, AGY-GGN-GGN-AGY-AGY-GGN-GGN, AGY-GGN-GGN-AGY-GGN-AGY-GGN, AGY-GGN-GGN-AGY-GGN-GGN-AGY, AGY-GGN-GGN-GGN-AGY-GGN-AGY, AGY-GGN-GGN-GGN-AGY-AGY-GGN, AGY-GGN-GGN-GGN-GGN-AGY-AGY, AGY-AGY-GGN-AGY-GGN-GGN-GGN, AGY-AGY-GGN-GGN-AGY-GGN-GGN, AGY-AGY-GGN-GGN-GGN-AGY-GGN, AGY-AGY-GGN-GGN-GGN-GGN-AGY, GGN-AGY-AGY-AGY-GGN-GGN-GGN, GGN-AGY-AGY-GGN-AGY-GGN-GGN, GGN-AGY-AGY-GGN-GGN-AGY-GGN, GGN-AGY-AGY-GGN-GGN-GGN-AGY, GGN-AGY-GGN-AGY-AGY-GGN-GGN, GGN-AGY-GGN-GGN-AGY-AGY-GGN, GGN-AGY-GGN-GGN-GGN-AGY-AGY, GGN-AGY-GGN-AGY-GGN-AGY-GGN, GGN-AGY-GGN-AGY-GGN-GGN-AGY, GGN-AGY-GGN-GGN-AGY-GGN-AGY, GGN-GGN-AGY-AGY-AGY-GGN-GGN, GGN-GGN-AGY-AGY-GGN-AGY-GGN, GGN-GGN-AGY-AGY-GGN-GGN-AGY, GGN-GGN-AGY-GGN-AGY-AGY-GGN, GGN-GGN-AGY-GGN-AGY-GGN-AGY, GGN-GGN-AGY-GGN-GGN-AGY-AGY, GGN-GGN-GGN-AGY-AGY-AGY-GGN, GGN-GGN-GGN-AGY-AGY-GGN-AGY, GGN-GGN-GGN-AGY-GGN-AGY-AGY, GGN-GGN-GGN-GGN-GGN-AGY-AGY, AGY-AGY-GGN-GGN-GGN-GGN-GGN, AGY-GGN-AGY-GGN-GGN-GGN-GGN, AGY-GGN-GGN-AGY-GGN-GGN-GGN, AGY-GGN-GGN-GGN-AGY-GGN-GGN, AGY-GGN-GGN-GGN-GGN-AGY-GGN, AGY-GGN-GGN-GGN-GGN-GGN-AGY, GGN-AGY-AGY-GGN-GGN-GGN-GGN, GGN-AGY-GGN-AGY-GGN-GGN-GGN, GGN-AGY-GGN-GGN-AGY-GGN-GGN, GGN-AGY-GGN-GGN-GGN-AGY-GGN, GGN-AGY-GGN-GGN-GGN-GGN-AGY, GGN-GGN-AGY-AGY-GGN-GGN-GGN, GGN-GGN-AGY-GGN-AGY-GGN-GGN, GGN-GGN-AGY-GGN-GGN-AGY-GGN, GGN-GGN-AGY-GGN-GGN-GGN-AGY, GGN-GGN-GGN-AGY-AGY-GGN-GGN, GGN-GGN-GGN-AGY-GGN-AGY-GGN, GGN-GGN-GGN-AGY-GGN-GGN-AGY, GGN-GGN-GGN-GGN-AGY-AGY-GGN, GGN-GGN-GGN-GGN-AGY-GGN-AGY-GGN-GGN-GGN-GGN-GGN-GGN-AGY, AGY-GGN-GGN-GGN-GGN-GGN-GGN, GGN-AGY-GGN-GGN-GGN-GGN-GGN, GGN-GGN-AGY-GGN-GGN-GGN-GGN, GGN-GGN-GGN-AGY-GGN-GGN-GGN, GGN-GGN-GGN-GGN-AGY-GGN-GGN, GGN-GGN-GGN-GGN-GGN-AGY-GGN |
| Oligonucleotides of peptide motifs containing 3-7 amino acide residues with G(glycine) as the major constituent and Q(Glutamine) as the minor constituent |
| GGN-GGN-CAR, CAR-GGN-GGN, GGN-CAR-GGN, GGN-GGN-GGN-CAR, CAR-GGN-GGN-GGN, GGN-CAR-GGN-GGN, GGN-GGN-CAR-GGN, GGN-GGN-GGN- |

TABLE 7-continued

| (SEQ ID NOS: 2482-4747, respectively, in order of appearance) |
| --- |
| GGN-CAR, CAR-GGN-GGN-GGN-GGN, GGN-CAR-GGN-GGN-GGN, GGN-GGN-CAR-GGN-GGN, GGN-GGN-GGN-CAR-GGN, GGN-GGN-GGN-CAR-CAR, CAR-CAR-GGN-GGN-GGN, CAR-GGN-CAR-GGN-GGN, CAR-GGN-GGN-CAR-GGN, CAR-GGN-GGN-GGN-CAR, GGN-CAR-CAR-GGN-GGN, GGN-CAR-GGN-CAR-GGN, GGN-CAR-GGN-GGN-CAR, GGN-GGN-CAR-CAR-GGN, GGN-GGN-CAR-GGN-CAR, GGN-GGN-GGN-GGN-GGN-CAR, CAR-GGN-GGN-GGN-GGN-GGN, GGN-CAR-GGN-GGN-GGN-GGN, GGN-GGN-CAR-GGN-GGN-GGN, GGN-GGN-GGN-CAR-GGN-GGN, GGN-GGN-GGN-GGN-CAR-GGN, GGN-GGN-GGN-GGN-CAR-CAR, CAR-CAR-GGN-GGN-GGN-GGN, CAR-GGN-CAR-GGN-GGN-GGN, CAR-GGN-GGN-CAR-GGN-GGN, CAR-GGN-GGN-GGN-CAR-GGN, CAR-GGN-GGN-GGN-GGN-CAR, GGN-CAR-CAR-GGN-GGN-GGN, GGN-CAR-GGN-CAR-GGN-GGN, GGN-CAR-GGN-GGN-CAR-GGN, GGN-CAR-GGN-GGN-GGN-CAR, GGN-GGN-CAR-CAR-GGN-GGN, GGN-GGN-CAR-GGN-CAR-GGN, GGN-GGN-CAR-GGN-GGN-CAR, GGN-GGN-GGN-CAR-CAR-GGN, GGN-GGN-GGN-CAR-GGN-CAR, GGN-GGN-GGN-GGN-CAR-CAR-CAR, CAR-CAR-CAR-GGN-GGN-GGN-GGN, CAR-GGN-CAR-CAR-GGN-GGN-GGN, CAR-GGN-CAR-GGN-CAR-GGN-GGN, CAR-GGN-CAR-GGN-GGN-CAR-GGN, CAR-GGN-CAR-GGN-GGN-GGN-CAR, CAR-GGN-GGN-CAR-CAR-GGN-GGN, CAR-GGN-GGN-CAR-GGN-CAR-GGN, CAR-GGN-GGN-CAR-GGN-GGN-CAR, CAR-GGN-GGN-GGN-CAR-GGN-CAR, CAR-GGN-GGN-GGN-CAR-CAR-GGN, CAR-GGN-GGN-GGN-GGN-CAR-CAR, CAR-CAR-GGN-CAR-GGN-GGN-GGN, CAR-CAR-GGN-GGN-CAR-GGN-GGN, CAR-CAR-GGN-GGN-GGN-CAR-GGN, CAR-CAR-GGN-GGN-GGN-GGN-CAR, GGN-CAR-CAR-CAR-GGN-GGN-GGN, GGN-CAR-CAR-GGN-CAR-GGN-GGN, GGN-CAR-CAR-GGN-GGN-CAR-GGN, GGN-CAR-CAR-GGN-GGN-GGN-CAR, GGN-CAR-GGN-CAR-CAR-GGN-GGN, GGN-CAR-GGN-GGN-CAR-CAR-GGN, GGN-CAR-GGN-GGN-GGN-CAR-CAR, GGN-CAR-GGN-CAR-GGN-CAR-GGN, GGN-CAR-GGN-CAR-GGN-GGN-CAR, GGN-CAR-GGN-GGN-CAR-GGN-CAR, GGN-GGN-CAR-CAR-CAR-GGN-GGN, GGN-GGN-CAR-CAR-GGN-CAR-GGN, GGN-GGN-CAR-CAR-GGN-GGN-CAR, GGN-GGN-CAR-GGN-CAR-CAR-GGN, GGN-GGN-CAR-GGN-CAR-GGN-CAR, GGN-GGN-CAR-GGN-GGN-CAR-CAR, GGN-GGN-GGN-CAR-CAR-CAR-GGN, GGN-GGN-GGN-CAR-CAR-GGN-CAR, GGN-GGN-GGN-CAR-GGN-CAR-CAR, GGN-GGN-GGN-GGN-GGN-CAR-CAR, CAR-CAR-GGN-GGN-GGN-GGN-GGN, CAR-GGN-CAR-GGN-GGN-GGN-GGN, CAR-GGN-GGN-CAR-GGN-GGN-GGN, CAR-GGN-GGN-GGN-CAR-GGN-GGN, CAR-GGN-GGN-GGN-GGN-CAR-GGN, CAR-GGN-GGN-GGN-GGN-GGN-CAR, GGN-CAR-CAR-GGN-GGN-GGN-GGN, GGN-CAR-GGN-CAR-GGN-GGN-GGN, GGN-CAR-GGN-GGN-CAR-GGN-GGN, GGN-CAR-GGN-GGN-GGN-CAR-GGN, GGN-CAR-GGN-GGN-GGN-GGN-CAR, GGN-GGN-CAR-CAR-GGN-GGN-GGN, GGN-GGN-CAR-GGN-CAR-GGN-GGN, GGN-GGN-CAR-GGN-GGN- |

TABLE 7-continued

| (SEQ ID NOS: 2482-4747, respectively, in order of appearance) |
|---|
| CAR-GGN, GGN-GGN-CAR-GGN-GGN-GGN-CAR, GGN-GGN-GGN-CAR-CAR-GGN-GGN, GGN-GGN-GGN-CAR-GGN-CAR-GGN, GGN-GGN-GGN-CAR-GGN-GGN-CAR, GGN-GGN-GGN-GGN-CAR-CAR-GGN, GGN-GGN-GGN-GGN-CAR-GGN-CAR-GGN-GGN-GGN-GGN-GGN-GGN-CAR, CAR-GGN-GGN-GGN-GGN-GGN-GGN, GGN-CAR-GGN-GGN-GGN-GGN-GGN, GGN-GGN-CAR-GGN-GGN-GGN-GGN, GGN-GGN-GGN-CAR-GGN-GGN-GGN, GGN-GGN-GGN-GGN-CAR-GGN-GGN, GGN-GGN-GGN-GGN-GGN-CAR-GGN |
| Oligonucleotides of peptide motifs containing 3-7 amino acide residues with G(glycine) as the major constituent and E(Glutamic Acid) as the minor constituent |
| GGN-GGN-GAR, GAR-GGN-GGN, GGN-GAR-GGN, GGN-GGN-GGN-GAR, GAR-GGN-GGN-GGN, GGN-GAR-GGN-GGN, GGN-GGN-GAR-GGN, GGN-GGN-GGN-GGN-GAR, GAR-GGN-GGN-GGN-GGN, GGN-GAR-GGN-GGN-GGN, GGN-GGN-GAR-GGN-GGN, GGN-GGN-GGN-GAR-GGN, GGN-GGN-GGN-GAR-GAR, GAR-GAR-GGN-GGN-GGN, GAR-GGN-GAR-GGN-GGN, GAR-GGN-GGN-GAR-GGN, GAR-GGN-GGN-GGN-GAR, GGN-GAR-GAR-GGN-GGN, GGN-GAR-GGN-GAR-GGN, GGN-GAR-GGN-GGN-GAR, GGN-GGN-GAR-GAR-GGN, GGN-GGN-GAR-GGN-GAR, GGN-GGN-GGN-GGN-GGN-GAR, GAR-GGN-GGN-GGN-GGN-GGN, GGN-GAR-GGN-GGN-GGN-GGN, GGN-GGN-GAR-GGN-GGN-GGN, GGN-GGN-GGN-GAR-GGN-GGN, GGN-GGN-GGN-GGN-GAR-GGN, GGN-GGN-GGN-GGN-GAR-GAR, GAR-GAR-GGN-GGN-GGN-GGN, GAR-GGN-GAR-GGN-GGN-GGN, GAR-GGN-GGN-GAR-GGN-GGN, GAR-GGN-GGN-GGN-GAR-GGN, GAR-GGN-GGN-GGN-GGN-GAR, GGN-GAR-GAR-GGN-GGN-GGN, GGN-GAR-GGN-GAR-GGN-GGN, GGN-GAR-GGN-GGN-GAR-GGN, GGN-GAR-GGN-GGN-GGN-GAR, GGN-GGN-GAR-GAR-GGN-GGN, GGN-GGN-GAR-GGN-GAR-GGN, GGN-GGN-GAR-GGN-GGN-GAR, GGN-GGN-GGN-GAR-GAR-GGN, GGN-GGN-GGN-GAR-GGN-GAR, GGN-GGN-GGN-GGN-GAR-GAR-GAR, GAR-GAR-GAR-GGN-GGN-GGN-GGN, GAR-GGN-GAR-GAR-GGN-GGN-GGN, GAR-GGN-GAR-GGN-GAR-GGN-GGN, GAR-GGN-GAR-GGN-GGN-GAR-GGN, GAR-GGN-GAR-GGN-GGN-GGN-GAR, GAR-GGN-GGN-GAR-GAR-GGN-GGN, GAR-GGN-GGN-GAR-GGN-GAR-GGN, GAR-GGN-GGN-GAR-GGN-GGN-GAR, GAR-GGN-GGN-GGN-GAR-GGN-GAR, GAR-GGN-GGN-GGN-GAR-GAR-GGN, GAR-GGN-GGN-GGN-GGN-GAR-GAR, GAR-GAR-GGN-GAR-GGN-GGN-GGN, GAR-GAR-GGN-GGN-GAR-GGN-GGN, GAR-GAR-GGN-GGN-GGN-GAR-GGN, GAR-GAR-GGN-GGN-GGN-GGN-GAR, GGN-GAR-GAR-GAR-GGN-GGN-GGN, GGN-GAR-GAR-GGN-GAR-GGN-GGN, GGN-GAR-GAR-GGN-GGN-GAR-GGN, GGN-GAR-GAR-GGN-GGN-GGN-GAR, GGN-GAR-GGN-GAR-GAR-GGN-GGN, GGN-GAR-GGN-GGN-GAR-GAR-GGN, GGN-GAR-GGN-GGN-GGN-GAR-GAR, GGN-GAR-GGN-GAR-GGN-GAR-GGN, GGN-GAR-GGN-GAR-GGN-GGN-GAR, GGN-GAR-GGN-GGN-GAR- |

TABLE 7-continued

| (SEQ ID NOS: 2482-4747, respectively, in order of appearance) |
|---|
| GGN-GAR, GGN-GGN-GAR-GAR-GAR-GGN-GGN, GGN-GGN-GAR-GAR-GGN-GAR-GGN, GGN-GGN-GAR-GAR-GGN-GGN-GAR, GGN-GGN-GAR-GGN-GAR-GAR-GGN, GGN-GGN-GAR-GGN-GAR-GGN-GAR, GGN-GGN-GAR-GGN-GGN-GAR-GAR, GGN-GGN-GGN-GAR-GAR-GAR-GGN, GGN-GGN-GGN-GAR-GAR-GGN-GAR, GGN-GGN-GGN-GAR-GGN-GAR-GAR, GGN-GGN-GGN-GGN-GGN-GAR-GAR, GAR-GAR-GGN-GGN-GGN-GGN-GGN, GAR-GGN-GAR-GGN-GGN-GGN-GGN, GAR-GGN-GGN-GAR-GGN-GGN-GGN, GAR-GGN-GGN-GGN-GAR-GGN-GGN, GAR-GGN-GGN-GGN-GGN-GAR-GGN, GAR-GGN-GGN-GGN-GGN-GGN-GAR, GGN-GAR-GAR-GGN-GGN-GGN-GGN, GGN-GAR-GGN-GAR-GGN-GGN-GGN, GGN-GAR-GGN-GGN-GAR-GGN-GGN, GGN-GAR-GGN-GGN-GGN-GAR-GGN, GGN-GAR-GGN-GGN-GGN-GGN-GAR, GGN-GGN-GAR-GAR-GGN-GGN-GGN, GGN-GGN-GAR-GGN-GAR-GGN-GGN, GGN-GGN-GAR-GGN-GGN-GAR-GGN, GGN-GGN-GAR-GGN-GGN-GGN-GAR, GGN-GGN-GGN-GAR-GAR-GGN-GGN, GGN-GGN-GGN-GAR-GGN-GAR-GGN, GGN-GGN-GGN-GAR-GGN-GGN-GAR, GGN-GGN-GGN-GGN-GAR-GAR-GGN, GGN-GGN-GGN-GGN-GAR-GGN-GAR-GGN-GGN-GGN-GGN-GGN-GGN-GAR, GAR-GGN-GGN-GGN-GGN-GGN-GGN, GGN-GAR-GGN-GGN-GGN-GGN-GGN, GGN-GGN-GAR-GGN-GGN-GGN-GGN, GGN-GGN-GGN-GAR-GGN-GGN-GGN, GGN-GGN-GGN-GGN-GAR-GGN-GGN, GGN-GGN-GGN-GGN-GGN-GAR-GGN |
| Oligonucleotides of peptide motifs containing 3-7 amino acide residues with G(glycine) as the major constituent and H(Histidine) as the minor constituent |
| GGN-GGN-CAY, CAY-GGN-GGN, GGN-CAY-GGN, GGN-GGN-GGN-CAY, CAY-GGN-GGN-GGN, GGN-CAY-GGN-GGN, GGN-GGN-CAY-GGN, GGN-GGN-GGN-GGN-CAY, CAY-GGN-GGN-GGN-GGN, GGN-CAY-GGN-GGN-GGN, GGN-GGN-CAY-GGN-GGN, GGN-GGN-GGN-CAY-GGN, GGN-GGN-GGN-CAY-CAY, CAY-CAY-GGN-GGN-GGN, CAY-GGN-CAY-GGN-GGN, CAY-GGN-GGN-CAY-GGN, CAY-GGN-GGN-GGN-CAY, GGN-CAY-CAY-GGN-GGN, GGN-CAY-GGN-CAY-GGN, GGN-CAY-GGN-GGN-CAY, GGN-GGN-CAY-CAY-GGN, GGN-GGN-CAY-GGN-CAY, GGN-GGN-GGN-GGN-GGN-CAY, CAY-GGN-GGN-GGN-GGN-GGN, GGN-CAY-GGN-GGN-GGN-GGN, GGN-GGN-CAY-GGN-GGN-GGN, GGN-GGN-GGN-CAY-GGN-GGN, GGN-GGN-GGN-GGN-CAY-GGN, GGN-GGN-GGN-GGN-CAY-CAY, CAY-CAY-GGN-GGN-GGN-GGN, CAY-GGN-CAY-GGN-GGN-GGN, CAY-GGN-GGN-CAY-GGN-GGN, CAY-GGN-GGN-GGN-CAY-GGN, CAY-GGN-GGN-GGN-GGN-CAY, GGN-CAY-CAY-GGN-GGN-GGN, GGN-CAY-GGN-CAY-GGN-GGN, GGN-CAY-GGN-GGN-CAY-GGN, GGN-CAY-GGN-GGN-GGN-CAY, GGN-GGN-CAY-CAY-GGN-GGN, GGN-GGN-CAY-GGN-CAY-GGN, GGN-GGN-CAY-GGN-GGN-CAY, GGN-GGN-GGN-CAY-CAY-GGN, GGN-GGN-GGN-CAY-GGN-CAY, GGN-GGN-GGN-GGN-CAY-CAY-CAY, CAY-CAY-CAY-GGN-GGN-GGN-GGN, CAY-GGN-CAY-CAY-GGN-GGN-GGN, CAY-GGN-CAY-GGN-CAY- |

TABLE 7-continued

| (SEQ ID NOS: 2482-4747, respectively, in order of appearance) |
|---|
| GGN-GGN, CAY-GGN-CAY-GGN-GGN-CAY-GGN, CAY-GGN-CAY-GGN-GGN-GGN-CAY, CAY-GGN-GGN-CAY-CAY-GGN-GGN, CAY-GGN-GGN-CAY-GGN-CAY-GGN, CAY-GGN-GGN-CAY-GGN-GGN-CAY, CAY-GGN-GGN-GGN-CAY-GGN-CAY, CAY-GGN-GGN-GGN-CAY-CAY-GGN, CAY-GGN-GGN-GGN-GGN-CAY-CAY, CAY-CAY-GGN-CAY-GGN-GGN-GGN, CAY-CAY-GGN-GGN-CAY-GGN-GGN, CAY-CAY-GGN-GGN-GGN-CAY-GGN, CAY-CAY-GGN-GGN-GGN-GGN-CAY, GGN-CAY-CAY-CAY-GGN-GGN-GGN, GGN-CAY-CAY-GGN-CAY-GGN-GGN, GGN-CAY-CAY-GGN-GGN-CAY-GGN, GGN-CAY-CAY-GGN-GGN-GGN-CAY, GGN-CAY-GGN-CAY-CAY-GGN-GGN, GGN-CAY-GGN-GGN-CAY-CAY-GGN, GGN-CAY-GGN-GGN-GGN-CAY-CAY, GGN-CAY-GGN-CAY-GGN-CAY-GGN, GGN-CAY-GGN-CAY-GGN-GGN-CAY, GGN-CAY-GGN-GGN-CAY-GGN-CAY, GGN-GGN-CAY-CAY-CAY-GGN-GGN, GGN-GGN-CAY-CAY-GGN-CAY-GGN, GGN-GGN-CAY-CAY-GGN-GGN-CAY, GGN-GGN-CAY-GGN-CAY-CAY-GGN, GGN-GGN-CAY-GGN-CAY-GGN-CAY, GGN-GGN-CAY-GGN-GGN-CAY-CAY, GGN-GGN-GGN-CAY-CAY-CAY-GGN, GGN-GGN-GGN-CAY-CAY-GGN-CAY, GGN-GGN-GGN-CAY-GGN-CAY-CAY, GGN-GGN-GGN-GGN-GGN-CAY-CAY, CAY-CAY-GGN-GGN-GGN-GGN-GGN, CAY-GGN-CAY-GGN-GGN-GGN-GGN, CAY-GGN-GGN-CAY-GGN-GGN-GGN, CAY-GGN-GGN-GGN-CAY-GGN-GGN, CAY-GGN-GGN-GGN-GGN-CAY-GGN, CAY-GGN-GGN-GGN-GGN-GGN-CAY, GGN-CAY-CAY-GGN-GGN-GGN-GGN, GGN-CAY-GGN-CAY-GGN-GGN-GGN, GGN-CAY-GGN-GGN-CAY-GGN-GGN, GGN-CAY-GGN-GGN-GGN-CAY-GGN, GGN-CAY-GGN-GGN-GGN-GGN-CAY, GGN-GGN-CAY-CAY-GGN-GGN-GGN, GGN-GGN-CAY-GGN-CAY-GGN-GGN, GGN-GGN-CAY-GGN-GGN-CAY-GGN, GGN-GGN-CAY-GGN-GGN-GGN-CAY, GGN-GGN-GGN-CAY-CAY-GGN-GGN, GGN-GGN-GGN-CAY-GGN-CAY-GGN, GGN-GGN-GGN-CAY-GGN-GGN-CAY, GGN-GGN-GGN-GGN-CAY-CAY-GGN, GGN-GGN-GGN-GGN-CAY-GGN-CAY-GGN-GGN-GGN-GGN-GGN-CAY, CAY-GGN-GGN-GGN-GGN-GGN-GGN, GGN-CAY-GGN-GGN-GGN-GGN-GGN, GGN-GGN-CAY-GGN-GGN-GGN-GGN, GGN-GGN-GGN-CAY-GGN-GGN-GGN, GGN-GGN-GGN-GGN-CAY-GGN-GGN, GGN-GGN-GGN-GGN-GGN-CAY-GGN |
| Oligonucleotides of peptide motifs containing 3-7 amino acide residues with G(glycine) as the major constituent and N(Asparagine) as the minor constituent |
| GGN-GGN-AAY, AAY-GGN-GGN, GGN-AAY-GGN, GGN-GGN-GGN-AAY, AAY-GGN-GGN-GGN, GGN-AAY-GGN-GGN, GGN-GGN-AAY-GGN, GGN-GGN-GGN-GGN-AAY, AAY-GGN-GGN-GGN-GGN, GGN-AAY-GGN-GGN-GGN, GGN-GGN-AAY-GGN-GGN, GGN-GGN-GGN-AAY-GGN, GGN-GGN-GGN-AAY-AAY, AAY-AAY-GGN-GGN-GGN, AAY-GGN-AAY-GGN-GGN, AAY-GGN-GGN-AAY-GGN, AAY-GGN-GGN-GGN-AAY, GGN-AAY-AAY-GGN-GGN, GGN-AAY-GGN-AAY- |

TABLE 7-continued

| (SEQ ID NOS: 2482-4747, respectively, in order of appearance) |
|---|
| GGN, GGN-AAY-GGN-GGN-AAY, GGN-GGN-AAY-AAY-GGN, GGN-GGN-AAY-GGN-AAY, GGN-GGN-GGN-GGN-GGN-AAY, AAY-GGN-GGN-GGN-GGN-GGN, GGN-AAY-GGN-GGN-GGN-GGN, GGN-GGN-AAY-GGN-GGN-GGN, GGN-GGN-GGN-AAY-GGN-GGN, GGN-GGN-GGN-GGN-AAY-GGN, GGN-GGN-GGN-GGN-AAY-AAY, AAY-AAY-GGN-GGN-GGN-GGN, AAY-GGN-AAY-GGN-GGN-GGN, AAY-GGN-GGN-AAY-GGN-GGN, AAY-GGN-GGN-GGN-AAY-GGN, AAY-GGN-GGN-GGN-GGN-AAY, GGN-AAY-AAY-GGN-GGN-GGN, GGN-AAY-GGN-AAY-GGN-GGN, GGN-AAY-GGN-GGN-AAY-GGN, GGN-AAY-GGN-GGN-GGN-AAY, GGN-GGN-AAY-AAY-GGN-GGN, GGN-GGN-AAY-GGN-AAY-GGN, GGN-GGN-AAY-GGN-GGN-AAY, GGN-GGN-GGN-AAY-AAY-GGN, GGN-GGN-GGN-AAY-GGN-AAY, GGN-GGN-GGN-GGN-AAY-AAY-AAY, AAY-AAY-AAY-GGN-GGN-GGN-GGN, AAY-GGN-AAY-AAY-GGN-GGN-GGN, AAY-GGN-AAY-GGN-AAY-GGN-GGN, AAY-GGN-AAY-GGN-GGN-AAY-GGN, AAY-GGN-AAY-GGN-GGN-GGN-AAY, AAY-GGN-GGN-AAY-AAY-GGN-GGN, AAY-GGN-GGN-AAY-GGN-AAY-GGN, AAY-GGN-GGN-AAY-GGN-GGN-AAY, AAY-GGN-GGN-GGN-AAY-GGN-AAY, AAY-GGN-GGN-GGN-AAY-AAY-GGN, AAY-GGN-GGN-GGN-GGN-AAY-AAY, AAY-AAY-GGN-AAY-GGN-GGN-GGN, AAY-AAY-GGN-GGN-AAY-GGN-GGN, AAY-AAY-GGN-GGN-GGN-AAY-GGN, AAY-AAY-GGN-GGN-GGN-GGN-AAY, GGN-AAY-AAY-AAY-GGN-GGN-GGN, GGN-AAY-AAY-GGN-AAY-GGN-GGN, GGN-AAY-AAY-GGN-GGN-AAY-GGN, GGN-AAY-AAY-GGN-GGN-GGN-AAY, GGN-AAY-GGN-AAY-AAY-GGN-GGN, GGN-AAY-GGN-GGN-AAY-AAY-GGN, GGN-AAY-GGN-GGN-GGN-AAY-AAY, GGN-AAY-GGN-AAY-GGN-AAY-GGN, AAY-GGN, GGN-AAY-GGN-AAY-GGN-GGN-AAY, GGN-AAY-GGN-GGN-AAY-GGN-AAY, GGN-GGN-AAY-AAY-AAY-GGN-GGN, GGN-GGN-AAY-AAY-GGN-AAY-GGN, GGN-GGN-AAY-AAY-GGN-GGN-AAY, GGN-GGN-AAY-GGN-AAY-AAY-GGN, GGN-GGN-AAY-GGN-AAY-GGN-AAY, GGN-GGN-AAY-GGN-GGN-AAY-AAY, GGN-GGN-GGN-AAY-AAY-AAY-GGN, GGN-GGN-GGN-AAY-AAY-GGN-AAY, GGN-GGN-GGN-AAY-GGN-AAY-AAY, GGN-GGN-GGN-GGN-GGN-AAY-AAY, AAY-AAY-GGN-GGN-GGN-GGN-GGN, AAY-GGN-AAY-GGN-GGN-GGN-GGN, AAY-GGN-GGN-AAY-GGN-GGN-GGN, AAY-GGN-GGN-GGN-AAY-GGN-GGN, AAY-GGN-GGN-GGN-GGN-AAY-GGN, AAY-GGN-GGN-GGN-GGN-GGN-AAY, GGN-AAY-AAY-GGN-GGN-GGN-GGN, GGN-AAY-GGN-AAY-GGN-GGN-GGN, GGN-AAY-GGN-GGN-AAY-GGN-GGN, GGN-AAY-GGN-GGN-GGN-AAY-GGN, GGN-AAY-GGN-GGN-GGN-GGN-AAY, GGN-GGN-AAY-AAY-GGN-GGN-GGN, GGN-GGN-AAY-GGN-AAY-GGN-GGN, GGN-GGN-AAY-GGN-GGN-AAY-GGN, GGN-GGN-AAY-GGN-GGN-GGN-AAY, GGN-GGN-GGN-AAY-AAY-GGN-GGN, GGN-GGN-GGN-AAY-GGN-AAY-GGN, GGN-GGN-GGN-AAY-GGN-GGN-AAY, GGN-GGN-GGN-GGN-AAY-AAY-GGN, GGN-GGN-GGN-GGN-AAY-GGN-AAY-GGN-GGN-GGN-GGN-GGN-GGN-AAY, AAY-GGN-GGN-GGN-GGN- |

TABLE 7-continued

| (SEQ ID NOS: 2482-4747, respectively, in order of appearance) |
|---|
| GGN-GGN, GGN-AAY-GGN-GGN-GGN-GGN-GGN, GGN-GGN-AAY-GGN-GGN-GGN-GGN, GGN-GGN-GGN-AAY-GGN-GGN-GGN, GGN-GGN-GGN-GGN-AAY-GGN-GGN, GGN-GGN-GGN-GGN-GGN-AAY-GGN |
| Oligonucleotides of peptide motifs containing 3-7 amino acide residues with G(glycine) as the major constituent and D(Aspartic Acid) as the minor constituent |
| GGN-GGN-GAY, GAY-GGN-GGN, GGN-GAY-GGN, GGN-GGN-GGN-GAY, GAY-GGN-GGN-GGN, GGN-GAY-GGN-GGN, GGN-GGN-GAY-GGN, GGN-GGN-GGN-GGN-GAY, GAY-GGN-GGN-GGN-GGN, GGN-GAY-GGN-GGN-GGN, GGN-GGN-GAY-GGN-GGN, GGN-GGN-GGN-GAY-GGN, GGN-GGN-GGN-GAY-GAY, GAY-GAY-GGN-GGN-GGN, GAY-GGN-GAY-GGN-GGN, GAY-GGN-GGN-GAY-GGN, GAY-GGN-GGN-GGN-GAY, GGN-GAY-GAY-GGN-GGN, GGN-GAY-GGN-GAY-GGN, GGN-GAY-GGN-GGN-GAY, GGN-GGN-GAY-GAY-GGN, GGN-GGN-GAY-GGN-GAY, GGN-GGN-GGN-GGN-GGN-GAY, GAY-GGN-GGN-GGN-GGN-GGN, GGN-GAY-GGN-GGN-GGN-GGN, GGN-GGN-GAY-GGN-GGN-GGN, GGN-GGN-GGN-GAY-GGN-GGN, GGN-GGN-GGN-GGN-GAY-GGN, GGN-GGN-GGN-GGN-GAY-GAY, GAY-GAY-GGN-GGN-GGN-GGN, GAY-GGN-GAY-GGN-GGN-GGN, GAY-GGN-GGN-GAY-GGN-GGN, GAY-GGN-GGN-GGN-GAY-GGN, GAY-GGN-GGN-GGN-GGN-GAY, GGN-GAY-GAY-GGN-GGN-GGN, GGN-GAY-GGN-GAY-GGN-GGN, GGN-GAY-GGN-GGN-GAY-GGN, GGN-GAY-GGN-GGN-GGN-GAY, GGN-GGN-GAY-GAY-GGN-GGN, GGN-GGN-GAY-GGN-GAY-GGN, GGN-GGN-GAY-GGN-GGN-GAY, GGN-GGN-GGN-GAY-GAY-GGN, GGN-GGN-GGN-GAY-GGN-GAY, GGN-GGN-GGN-GGN-GAY-GAY-GAY, GAY-GAY-GAY-GGN-GGN-GGN-GGN, GAY-GGN-GAY-GAY-GGN-GGN-GGN, GAY-GGN-GAY-GGN-GAY-GGN-GGN, GAY-GGN-GAY-GGN-GGN-GAY-GGN, GAY-GGN-GAY-GGN-GGN-GGN-GAY, GAY-GGN-GGN-GAY-GAY-GGN-GGN, GAY-GGN-GGN-GAY-GGN-GAY-GGN, GAY-GGN-GGN-GAY-GGN-GGN-GAY, GAY-GGN-GGN-GGN-GAY-GGN-GAY, GAY-GGN-GGN-GGN-GAY-GAY-GGN, GAY-GGN-GGN-GGN-GGN-GAY-GAY, GAY-GAY-GGN-GAY-GGN-GGN-GGN, GAY-GAY-GGN-GGN-GAY-GGN-GGN, GAY-GAY-GGN-GGN-GGN-GAY-GGN, GAY-GAY-GGN-GGN-GGN-GGN-GAY, GGN-GAY-GAY-GAY-GGN-GGN-GGN, GGN-GAY-GAY-GGN-GAY-GGN-GGN, GGN-GAY-GAY-GGN-GGN-GAY-GGN, GGN-GAY-GAY-GGN-GGN-GGN-GAY, GGN-GAY-GGN-GAY-GAY-GGN-GGN, GGN-GAY-GGN-GGN-GAY-GAY-GGN, GGN-GAY-GGN-GGN-GGN-GAY-GAY, GGN-GAY-GGN-GAY-GGN-GAY-GGN, GGN-GAY-GGN-GAY-GGN-GGN-GAY, GGN-GAY-GGN-GGN-GAY-GGN-GAY, GGN-GGN-GAY-GAY-GAY-GGN-GGN, GGN-GGN-GAY-GAY-GGN-GAY-GGN, GGN-GGN-GAY-GAY-GGN-GGN-GAY, GGN-GGN-GAY-GGN-GAY-GAY-GGN, GGN-GGN-GAY-GGN-GAY-GGN-GAY, GGN-GGN-GAY-GGN-GGN-GAY-GAY, GGN-GGN-GGN-GAY-GAY-GAY-GGN, GGN-GGN-GGN-GAY-GAY- |

TABLE 7-continued

| (SEQ ID NOS: 2482-4747, respectively, in order of appearance) |
|---|
| GGN-GAY, GGN-GGN-GGN-GAY-GGN-GAY-GAY, GGN-GGN-GGN-GGN-GGN-GAY-GAY, GAY-GAY-GGN-GGN-GGN-GGN-GGN, GAY-GGN-GAY-GGN-GGN-GGN-GGN, GAY-GGN-GGN-GAY-GGN-GGN-GGN, GAY-GGN-GGN-GGN-GAY-GGN-GGN, GAY-GGN-GGN-GGN-GGN-GAY-GGN, GAY-GGN-GGN-GGN-GGN-GGN-GAY, GGN-GAY-GAY-GGN-GGN-GGN-GGN, GGN-GAY-GGN-GAY-GGN-GGN-GGN, GGN-GAY-GGN-GGN-GAY-GGN-GGN, GGN-GAY-GGN-GGN-GGN-GAY-GGN, GGN-GAY-GGN-GGN-GGN-GGN-GAY, GGN-GGN-GAY-GAY-GGN-GGN-GGN, GGN-GGN-GAY-GGN-GAY-GGN-GGN, GGN-GGN-GAY-GGN-GGN-GAY-GGN, GGN-GGN-GAY-GGN-GGN-GGN-GAY, GGN-GGN-GGN-GAY-GAY-GGN-GGN, GGN-GGN-GGN-GAY-GGN-GAY-GGN, GGN-GGN-GGN-GAY-GGN-GGN-GAY, GGN-GGN-GGN-GGN-GAY-GAY-GGN, GGN-GGN-GGN-GGN-GAY-GGN-GAY-GGN-GGN-GGN-GGN-GGN-GGN-GAY, GAY-GGN-GGN-GGN-GGN-GGN-GGN, GGN-GAY-GGN-GGN-GGN-GGN-GGN, GGN-GGN-GAY-GGN-GGN-GGN-GGN, GGN-GGN-GGN-GAY-GGN-GGN-GGN, GGN-GGN-GGN-GGN-GAY-GGN-GGN, GGN-GGN-GGN-GGN-GGN-GAY-GGN |
| Q(glutamine) as major constituent<br>Oligonucleotides of peptide motifs containing 3-7 amino acide residues with Q(Glutamine) as the major constituent and T(Threonine) as the minor constituent |
| CAR-CAR-ACN, ACN-CAR-CAR, CAR-ACN-CAR, CAR-CAR-CAR-ACN, ACN-CAR-CAR-CAR, CAR-ACN-CAR-CAR, CAR-CAR-ACN-CAR, CAR-CAR-CAR-CAR-ACN, ACN-CAR-CAR-CAR-CAR, CAR-ACN-CAR-CAR-CAR, CAR-CAR-ACN-CAR-CAR, CAR-CAR-CAR-ACN-CAR, CAR-CAR-CAR-ACN-ACN, ACN-ACN-CAR-CAR-CAR, ACN-CAR-ACN-CAR-CAR, ACN-CAR-CAR-ACN-CAR, ACN-CAR-CAR-CAR-ACN, CAR-ACN-ACN-CAR-CAR, CAR-ACN-CAR-ACN-CAR, CAR-ACN-CAR-CAR-ACN, CAR-CAR-ACN-ACN-CAR, CAR-CAR-ACN-CAR-ACN, CAR-CAR-CAR-CAR-CAR-ACN, ACN-CAR-CAR-CAR-CAR-CAR, CAR-ACN-CAR-CAR-CAR-CAR, CAR-CAR-ACN-CAR-CAR-CAR, CAR-CAR-CAR-ACN-CAR-CAR, CAR-CAR-CAR-CAR-ACN-CAR, CAR-CAR-CAR-CAR-ACN-ACN, ACN-ACN-CAR-CAR-CAR-CAR, ACN-CAR-ACN-CAR-CAR-CAR, ACN-CAR-CAR-ACN-CAR-CAR, ACN-CAR-CAR-CAR-ACN-CAR, ACN-CAR-CAR-CAR-CAR-ACN, CAR-ACN-ACN-CAR-CAR-CAR, CAR-ACN-CAR-ACN-CAR-CAR, CAR-ACN-CAR-CAR-ACN-CAR, CAR-ACN-CAR-CAR-CAR-ACN, CAR-CAR-ACN-ACN-CAR-CAR, CAR-CAR-ACN-CAR-ACN-CAR, CAR-CAR-ACN-CAR-CAR-ACN, CAR-CAR-CAR-ACN-ACN-CAR, CAR-CAR-CAR-ACN-CAR-ACN, CAR-CAR-CAR-CAR-ACN-ACN-ACN, ACN-ACN-ACN-CAR-CAR-CAR-CAR, ACN-CAR-ACN-ACN-CAR-CAR-CAR, ACN-CAR-ACN-CAR-ACN-CAR-CAR, ACN-CAR-ACN-CAR-CAR-ACN-CAR, ACN-CAR-ACN-CAR-CAR-CAR-ACN, ACN-CAR-CAR-ACN-ACN-CAR-CAR, ACN-CAR-CAR-ACN-CAR-ACN-CAR, ACN-CAR-CAR-ACN-CAR-CAR-ACN, ACN-CAR-CAR-CAR-ACN- |

TABLE 7-continued

| (SEQ ID NOS: 2482-4747, respectively, in order of appearance) |
|---|
| CAR-ACN, ACN-CAR-CAR-CAR-ACN-ACN-CAR, ACN-CAR-CAR-CAR-CAR-ACN-ACN, ACN-ACN-CAR-ACN-CAR-CAR-CAR, ACN-ACN-CAR-CAR-ACN-CAR-CAR, ACN-ACN-CAR-CAR-CAR-ACN-CAR, ACN-ACN-CAR-CAR-CAR-CAR-ACN, CAR-ACN-ACN-ACN-CAR-CAR-CAR, CAR-ACN-ACN-CAR-ACN-CAR-CAR, CAR-ACN-ACN-CAR-CAR-ACN-CAR, CAR-ACN-ACN-CAR-CAR-CAR-ACN, CAR-ACN-CAR-ACN-ACN-CAR-CAR, CAR-ACN-CAR-CAR-ACN-ACN-CAR, CAR-ACN-CAR-CAR-CAR-ACN-ACN, CAR-ACN-CAR-ACN-CAR-ACN-CAR, CAR-ACN-CAR-ACN-CAR-CAR-ACN, CAR-ACN-CAR-CAR-ACN-CAR-ACN, CAR-CAR-ACN-ACN-ACN-CAR-CAR, CAR-CAR-ACN-ACN-CAR-ACN-CAR, CAR-CAR-ACN-ACN-CAR-CAR-ACN, CAR-CAR-ACN-CAR-ACN-ACN-CAR, CAR-CAR-ACN-CAR-ACN-CAR-ACN, CAR-CAR-ACN-CAR-CAR-ACN-ACN, CAR-CAR-CAR-ACN-ACN-ACN-CAR, CAR-CAR-CAR-ACN-ACN-CAR-ACN, CAR-CAR-CAR-ACN-CAR-ACN-ACN, CAR-CAR-CAR-CAR-CAR-ACN-ACN, ACN-ACN-CAR-CAR-CAR-CAR-CAR, ACN-CAR-ACN-CAR-CAR-CAR-CAR, ACN-CAR-CAR-ACN-CAR-CAR-CAR, ACN-CAR-CAR-CAR-ACN-CAR-CAR, ACN-CAR-CAR-CAR-CAR-ACN-CAR, ACN-CAR-CAR-CAR-CAR-CAR-ACN, CAR-ACN-ACN-CAR-CAR-CAR-CAR, CAR-ACN-CAR-ACN-CAR-CAR-CAR, CAR-ACN-CAR-CAR-ACN-CAR-CAR, CAR-ACN-CAR-CAR-CAR-ACN-CAR, CAR-ACN-CAR-CAR-CAR-CAR-ACN, CAR-CAR-ACN-ACN-CAR-CAR-CAR, CAR-CAR-ACN-CAR-ACN-CAR-CAR, CAR-CAR-ACN-CAR-CAR-ACN-CAR, CAR-CAR-ACN-CAR-CAR-CAR-ACN, CAR-CAR-CAR-ACN-ACN-CAR-CAR, CAR-CAR-CAR-ACN-CAR-ACN-CAR, CAR-CAR-CAR-ACN-CAR-CAR-ACN, CAR-CAR-CAR-CAR-ACN-ACN-CAR, CAR-CAR-CAR-CAR-ACN-CAR-ACN-CAR-CAR-CAR-CAR-CAR-CAR-ACN, ACN-CAR-CAR-CAR-CAR-CAR-CAR, CAR-ACN-CAR-CAR-CAR-CAR-CAR, CAR-CAR-ACN-CAR-CAR-CAR-CAR, CAR-CAR-CAR-ACN-CAR-CAR-CAR, CAR-CAR-CAR-CAR-ACN-CAR-CAR, CAR-CAR-CAR-CAR-CAR-ACN-CAR |
| Oligonucleotides of peptide motifs containing 3-7 amino acide residues with Q(Glutamine) as the major constituent and A(Alanine) as the minor constituent |
| CAR-CAR-GCN, GCN-CAR-CAR, CAR-GCN-CAR, CAR-CAR-CAR-GCN, GCN-CAR-CAR-CAR, CAR-GCN-CAR-CAR, CAR-CAR-GCN-CAR, CAR-CAR-CAR-CAR-GCN, GCN-CAR-CAR-CAR-CAR, CAR-GCN-CAR-CAR-CAR, CAR-CAR-GCN-CAR-CAR, CAR-CAR-CAR-GCN-CAR, CAR-CAR-CAR-GCN-GCN, GCN-GCN-CAR-CAR-CAR, GCN-CAR-GCN-CAR-CAR, GCN-CAR-CAR-GCN-CAR, GCN-CAR-CAR-CAR-GCN, CAR-GCN-GCN-CAR-CAR, CAR-GCN-CAR-GCN-CAR, CAR-GCN-CAR-CAR-GCN, CAR-CAR-GCN-GCN-CAR, CAR-CAR-GCN-CAR-GCN, CAR-CAR-CAR-CAR-CAR-GCN, GCN-CAR-CAR-CAR-CAR-CAR, CAR-GCN-CAR-CAR-CAR-CAR, CAR-CAR-GCN-CAR-CAR-CAR, CAR-CAR-CAR-GCN-CAR-CAR, CAR-CAR-CAR-CAR-GCN-CAR, CAR-CAR-CAR-CAR- |

TABLE 7-continued

| (SEQ ID NOS: 2482-4747, respectively, in order of appearance) |
| --- |

GCN-GCN, GCN-GCN-CAR-CAR-CAR-CAR, GCN-CAR-GCN-CAR-CAR-CAR, GCN-CAR-CAR-GCN-CAR-CAR, GCN-CAR-CAR-CAR-GCN-CAR, GCN-CAR-CAR-CAR-CAR-GCN, CAR-GCN-GCN-CAR-CAR-CAR, CAR-GCN-CAR-GCN-CAR-CAR, CAR-GCN-CAR-CAR-GCN-CAR, CAR-GCN-CAR-CAR-CAR-GCN, CAR-CAR-GCN-GCN-CAR-CAR, CAR-CAR-GCN-CAR-GCN-CAR, CAR-CAR-GCN-CAR-CAR-GCN, CAR-CAR-CAR-GCN-GCN-CAR, CAR-CAR-CAR-GCN-CAR-GCN, CAR-CAR-CAR-CAR-GCN-GCN-GCN, GCN-GCN-GCN-CAR-CAR-CAR-CAR, GCN-CAR-GCN-GCN-CAR-CAR-CAR, GCN-CAR-GCN-CAR-GCN-CAR-CAR, GCN-CAR-GCN-CAR-CAR-GCN-CAR, GCN-CAR-GCN-CAR-CAR-CAR-GCN, GCN-CAR-CAR-GCN-GCN-CAR-CAR, GCN-CAR-CAR-GCN-CAR-GCN-CAR, GCN-CAR-CAR-GCN-CAR-CAR-GCN, GCN-CAR-CAR-CAR-GCN-CAR-GCN, GCN-CAR-CAR-CAR-GCN-GCN-CAR, GCN-CAR-CAR-CAR-CAR-GCN-GCN, GCN-GCN-CAR-GCN-CAR-CAR-CAR, GCN-GCN-CAR-CAR-GCN-CAR-CAR, GCN-GCN-CAR-CAR-CAR-GCN-CAR, GCN-GCN-CAR-CAR-CAR-CAR-GCN, CAR-GCN-GCN-GCN-CAR-CAR-CAR, CAR-GCN-GCN-CAR-GCN-CAR-CAR, CAR-GCN-GCN-CAR-CAR-GCN-CAR, CAR-GCN-GCN-CAR-CAR-CAR-GCN, CAR-GCN-CAR-GCN-GCN-CAR-CAR, CAR-GCN-CAR-CAR-GCN-GCN-CAR, CAR-GCN-CAR-CAR-CAR-GCN-GCN, CAR-GCN-CAR-GCN-CAR-GCN-CAR, CAR-GCN-CAR-GCN-CAR-CAR-GCN, CAR-GCN-CAR-CAR-GCN-CAR-GCN, CAR-CAR-GCN-GCN-GCN-CAR-CAR, CAR-CAR-GCN-GCN-CAR-GCN-CAR, CAR-CAR-GCN-GCN-CAR-CAR-GCN, CAR-CAR-GCN-CAR-GCN-GCN-CAR, CAR-CAR-GCN-CAR-GCN-CAR-GCN, CAR-CAR-GCN-CAR-CAR-GCN-GCN, CAR-CAR-CAR-GCN-GCN-GCN-CAR, CAR-CAR-CAR-GCN-GCN-CAR-GCN, CAR-CAR-CAR-GCN-CAR-GCN-GCN, CAR-CAR-CAR-CAR-CAR-GCN-GCN, GCN-GCN-CAR-CAR-CAR-CAR-CAR, GCN-CAR-GCN-CAR-CAR-CAR-CAR, GCN-CAR-CAR-GCN-CAR-CAR-CAR, GCN-CAR-CAR-CAR-GCN-CAR-CAR, GCN-CAR-CAR-CAR-CAR-GCN-CAR, GCN-CAR-CAR-CAR-CAR-CAR-GCN, CAR-GCN-GCN-CAR-CAR-CAR-CAR, CAR-GCN-CAR-GCN-CAR-CAR-CAR, CAR-GCN-CAR-CAR-GCN-CAR-CAR, CAR-GCN-CAR-CAR-CAR-GCN-CAR, CAR-GCN-CAR-CAR-CAR-CAR-GCN, CAR-CAR-GCN-GCN-CAR-CAR-CAR, CAR-CAR-GCN-CAR-GCN-CAR-CAR, CAR-CAR-GCN-CAR-CAR-GCN-CAR, CAR-CAR-GCN-CAR-CAR-CAR-GCN, CAR-CAR-CAR-GCN-GCN-CAR-CAR, CAR-CAR-CAR-GCN-CAR-GCN-CAR, CAR-CAR-CAR-GCN-CAR-CAR-GCN, CAR-CAR-CAR-CAR-GCN-GCN-CAR, CAR-CAR-CAR-CAR-GCN-CAR-GCN-CAR-CAR-CAR-CAR-CAR-CAR-GCN, GCN-CAR-CAR-CAR-CAR-CAR-CAR, CAR-GCN-CAR-CAR-CAR-CAR-CAR, CAR-CAR-GCN-CAR-CAR-CAR-CAR, CAR-CAR-CAR-GCN-CAR-CAR-CAR, CAR-CAR-CAR-CAR-GCN-CAR-CAR, CAR-CAR-CAR-CAR-CAR-GCN-CAR

TABLE 7-continued

| (SEQ ID NOS: 2482-4747, respectively, in order of appearance) |
|---|
| Oligonucleotides of peptide motifs containing 3-7 amino acide residues with Q(Glutamine) as the major constituent and S(Serine) as the minor constituent |

CAR-CAR-AGY, AGY-CAR-CAR, CAR-AGY-CAR, CAR-CAR-CAR-AGY, AGY-CAR-CAR-CAR, CAR-AGY-CAR-CAR, CAR-CAR-AGY-CAR, CAR-CAR-CAR-CAR-AGY, AGY-CAR-CAR-CAR-CAR, CAR-AGY-CAR-CAR-CAR, CAR-CAR-AGY-CAR-CAR, CAR-CAR-CAR-AGY-CAR, CAR-CAR-CAR-AGY-AGY, AGY-AGY-CAR-CAR-CAR, AGY-CAR-AGY-CAR-CAR, AGY-CAR-CAR-AGY-CAR, AGY-CAR-CAR-CAR-AGY, CAR-AGY-AGY-CAR-CAR, CAR-AGY-CAR-AGY-CAR, CAR-AGY-CAR-CAR-AGY, CAR-CAR-AGY-AGY-CAR, CAR-CAR-AGY-CAR-AGY, CAR-CAR-CAR-CAR-CAR-AGY, AGY-CAR-CAR-CAR-CAR-CAR, CAR-AGY-CAR-CAR-CAR-CAR, CAR-CAR-AGY-CAR-CAR-CAR, CAR-CAR-CAR-AGY-CAR-CAR, CAR-CAR-CAR-CAR-AGY-CAR, CAR-CAR-CAR-CAR-AGY-AGY, AGY-AGY-CAR-CAR-CAR-CAR, AGY-CAR-AGY-CAR-CAR-CAR, AGY-CAR-CAR-AGY-CAR-CAR, AGY-CAR-CAR-CAR-AGY-CAR, AGY-CAR-CAR-CAR-CAR-AGY, CAR-AGY-AGY-CAR-CAR-CAR, CAR-AGY-CAR-AGY-CAR-CAR, CAR-AGY-CAR-CAR-AGY-CAR, CAR-AGY-CAR-CAR-CAR-AGY, CAR-CAR-AGY-AGY-CAR-CAR, CAR-CAR-AGY-CAR-AGY-CAR, CAR-CAR-AGY-CAR-CAR-AGY, CAR-CAR-CAR-AGY-AGY-CAR, CAR-CAR-CAR-AGY-CAR-AGY, CAR-CAR-CAR-CAR-AGY-AGY-AGY, AGY-AGY-AGY-CAR-CAR-CAR-CAR, AGY-CAR-AGY-AGY-CAR-CAR-CAR, AGY-CAR-AGY-CAR-AGY-CAR-CAR, AGY-CAR-AGY-CAR-CAR-AGY-CAR, AGY-CAR-AGY-CAR-CAR-CAR-AGY, AGY-CAR-CAR-AGY-AGY-CAR-CAR, AGY-CAR-CAR-AGY-CAR-AGY-CAR, AGY-CAR-CAR-AGY-CAR-CAR-AGY, AGY-CAR-CAR-CAR-AGY-CAR-AGY, AGY-CAR-CAR-CAR-AGY-AGY-CAR, AGY-CAR-CAR-CAR-CAR-AGY-AGY, AGY-AGY-CAR-AGY-CAR-CAR-CAR, AGY-AGY-CAR-CAR-AGY-CAR-CAR, AGY-AGY-CAR-CAR-CAR-AGY-CAR, AGY-AGY-CAR-CAR-CAR-CAR-AGY, CAR-AGY-AGY-AGY-CAR-CAR-CAR, CAR-AGY-AGY-CAR-AGY-CAR-CAR, CAR-AGY-AGY-CAR-CAR-AGY-CAR, CAR-AGY-AGY-CAR-CAR-CAR-AGY, CAR-AGY-CAR-AGY-AGY-CAR-CAR, CAR-AGY-CAR-CAR-AGY-AGY-CAR, CAR-AGY-CAR-CAR-CAR-AGY-AGY, CAR-AGY-CAR-AGY-CAR-AGY-CAR, CAR-AGY-CAR-AGY-CAR-CAR-AGY, CAR-AGY-CAR-CAR-AGY-CAR-AGY, CAR-CAR-AGY-AGY-AGY-CAR-CAR, CAR-CAR-AGY-AGY-CAR-AGY-CAR, CAR-CAR-AGY-AGY-CAR-CAR-AGY, CAR-CAR-AGY-CAR-AGY-AGY-CAR, CAR-CAR-AGY-CAR-AGY-CAR-AGY, CAR-CAR-AGY-CAR-CAR-AGY-AGY, CAR-CAR-CAR-AGY-AGY-AGY-CAR, CAR-CAR-CAR-AGY-AGY-CAR-AGY, CAR-CAR-CAR-AGY-CAR-AGY-AGY, CAR-CAR-CAR-CAR-CAR-AGY-AGY, AGY-AGY-CAR-CAR-CAR-CAR-CAR, AGY-CAR-AGY-CAR-CAR-CAR-CAR, AGY-CAR-CAR-AGY-CAR-CAR-CAR, AGY-CAR-CAR-CAR-AGY-CAR-CAR, AGY-CAR-CAR-CAR-CAR-AGY-CAR, AGY-CAR-CAR-CAR-CAR-

TABLE 7-continued

| (SEQ ID NOS: 2482-4747, respectively, in order of appearance) |
|---|
| CAR-AGY, CAR-AGY-AGY-CAR-CAR-CAR-CAR, CAR-AGY-CAR-AGY-CAR-CAR-CAR, CAR-AGY-CAR-CAR-AGY-CAR-CAR, CAR-AGY-CAR-CAR-CAR-AGY-CAR, CAR-AGY-CAR-CAR-CAR-CAR-AGY, CAR-CAR-AGY-AGY-CAR-CAR-CAR, CAR-CAR-AGY-CAR-AGY-CAR-CAR, CAR-CAR-AGY-CAR-CAR-AGY-CAR, CAR-CAR-AGY-CAR-CAR-CAR-AGY, CAR-CAR-CAR-AGY-AGY-CAR-CAR, CAR-CAR-CAR-AGY-CAR-AGY-CAR, CAR-CAR-CAR-AGY-CAR-CAR-AGY, CAR-CAR-CAR-CAR-AGY-AGY-CAR, CAR-CAR-CAR-CAR-AGY-CAR-AGY-CAR-CAR-CAR-CAR-CAR-CAR-AGY, AGY-CAR-CAR-CAR-CAR-CAR-CAR, CAR-AGY-CAR-CAR-CAR-CAR-CAR, CAR-CAR-AGY-CAR-CAR-CAR-CAR, CAR-CAR-CAR-AGY-CAR-CAR-CAR, CAR-CAR-CAR-CAR-AGY-CAR-CAR, CAR-CAR-CAR-CAR-CAR-AGY-CAR |
| Oligonucleotides of peptide motifs containing 3-7 amino acide residues with Q(Glutamine) as the major constituent and E(Glutamic Acid) as the minor constituent |
| CAR-CAR-GAR, GAR-CAR-CAR, CAR-GAR-CAR, CAR-CAR-CAR-GAR, GAR-CAR-CAR-CAR, CAR-GAR-CAR-CAR, CAR-CAR-GAR-CAR, CAR-CAR-CAR-CAR-GAR, GAR-CAR-CAR-CAR-CAR, CAR-GAR-CAR-CAR-CAR, CAR-CAR-GAR-CAR-CAR, CAR-CAR-CAR-GAR-CAR, CAR-CAR-CAR-GAR-GAR, GAR-GAR-CAR-CAR-CAR, GAR-CAR-GAR-CAR-CAR, GAR-CAR-CAR-GAR-CAR, GAR-CAR-CAR-CAR-GAR, CAR-GAR-GAR-CAR-CAR, CAR-GAR-CAR-GAR-CAR, CAR-GAR-CAR-CAR-GAR, CAR-CAR-GAR-GAR-CAR, CAR-CAR-GAR-CAR-GAR, CAR-CAR-CAR-CAR-CAR-GAR, GAR-CAR-CAR-CAR-CAR-CAR, CAR-GAR-CAR-CAR-CAR-CAR, CAR-CAR-GAR-CAR-CAR-CAR, CAR-CAR-CAR-GAR-CAR-CAR, CAR-CAR-CAR-CAR-GAR-CAR, CAR-CAR-CAR-CAR-GAR-GAR, GAR-GAR-CAR-CAR-CAR-CAR, GAR-CAR-GAR-CAR-CAR-CAR, GAR-CAR-CAR-GAR-CAR-CAR, GAR-CAR-CAR-CAR-GAR-CAR, GAR-CAR-CAR-CAR-CAR-GAR, CAR-GAR-GAR-CAR-CAR-CAR, CAR-GAR-CAR-GAR-CAR-CAR, CAR-GAR-CAR-CAR-GAR-CAR, CAR-GAR-CAR-CAR-CAR-GAR, CAR-CAR-GAR-GAR-CAR-CAR, CAR-CAR-GAR-CAR-GAR-CAR, CAR-CAR-GAR-CAR-CAR-GAR, CAR-CAR-CAR-GAR-GAR-CAR, CAR-CAR-CAR-GAR-CAR-GAR, CAR-CAR-CAR-CAR-GAR-GAR-GAR, GAR-GAR-GAR-CAR-CAR-CAR-CAR, GAR-CAR-GAR-GAR-CAR-CAR-CAR, GAR-CAR-GAR-CAR-GAR-CAR-CAR, GAR-CAR-GAR-CAR-CAR-GAR-CAR, GAR-CAR-GAR-CAR-CAR-CAR-GAR, GAR-CAR-CAR-GAR-GAR-CAR-CAR, GAR-CAR-CAR-GAR-CAR-GAR-CAR, GAR-CAR-CAR-GAR-CAR-CAR-GAR, GAR-CAR-CAR-CAR-GAR-CAR-GAR, GAR-CAR-CAR-CAR-GAR-GAR-CAR, GAR-CAR-CAR-CAR-CAR-GAR-GAR, GAR-GAR-CAR-GAR-CAR-CAR-CAR, GAR-GAR-CAR-CAR-GAR-CAR-CAR, GAR-GAR-CAR-CAR-CAR-GAR-CAR, GAR-GAR-CAR-CAR-CAR-CAR-GAR, CAR-GAR-GAR-GAR-CAR-CAR-CAR, CAR-GAR-GAR-CAR-GAR- |

TABLE 7-continued

| (SEQ ID NOS: 2482-4747, respectively, in order of appearance) |
|---|
| CAR-CAR, CAR-GAR-GAR-CAR-CAR-GAR-CAR, CAR-GAR-GAR-CAR-CAR- |
| CAR-GAR, CAR-GAR-CAR-GAR-GAR-CAR-CAR, CAR-GAR-CAR-CAR-GAR- |
| GAR-CAR, CAR-GAR-CAR-CAR-CAR-GAR-GAR, CAR-GAR-CAR-GAR-CAR- |
| GAR-CAR, CAR-GAR-CAR-GAR-CAR-CAR-GAR, CAR-GAR-CAR-CAR-GAR- |
| CAR-GAR, CAR-CAR-GAR-GAR-GAR-CAR-CAR, CAR-CAR-GAR-GAR-CAR- |
| GAR-CAR, CAR-CAR-GAR-GAR-CAR-CAR-GAR, CAR-CAR-GAR-CAR-GAR- |
| GAR-CAR, CAR-CAR-GAR-CAR-GAR-CAR-GAR, CAR-CAR-GAR-CAR-CAR- |
| GAR-GAR, CAR-CAR-CAR-GAR-GAR-GAR-CAR, CAR-CAR-CAR-GAR-GAR- |
| CAR-GAR, CAR-CAR-CAR-GAR-CAR-GAR-GAR, CAR-CAR-CAR-CAR-CAR- |
| GAR-GAR, GAR-GAR-CAR-CAR-CAR-CAR-CAR, GAR-CAR-GAR-CAR-CAR- |
| CAR-CAR, GAR-CAR-CAR-GAR-CAR-CAR-CAR, GAR-CAR-CAR-CAR-GAR- |
| CAR-CAR, GAR-CAR-CAR-CAR-CAR-GAR-CAR, GAR-CAR-CAR-CAR-CAR- |
| CAR-GAR, CAR-GAR-GAR-CAR-CAR-CAR-CAR, CAR-GAR-CAR-GAR-CAR- |
| CAR-CAR, CAR-GAR-CAR-CAR-GAR-CAR-CAR, CAR-GAR-CAR-CAR-CAR- |
| GAR-CAR, CAR-GAR-CAR-CAR-CAR-CAR-GAR, CAR-CAR-GAR-GAR-CAR- |
| CAR-CAR, CAR-CAR-GAR-CAR-GAR-CAR-CAR, CAR-CAR-GAR-CAR-CAR- |
| GAR-CAR, CAR-CAR-GAR-CAR-CAR-CAR-GAR, CAR-CAR-CAR-GAR-GAR- |
| CAR-CAR, CAR-CAR-CAR-GAR-CAR-GAR-CAR, CAR-CAR-CAR-GAR-CAR- |
| CAR-GAR, CAR-CAR-CAR-CAR-GAR-GAR-CAR, CAR-CAR-CAR-CAR-GAR- |
| CAR-GAR-CAR-CAR-CAR-CAR-CAR-CAR-GAR, GAR-CAR-CAR-CAR-CAR- |
| CAR-CAR, CAR-GAR-CAR-CAR-CAR-CAR-CAR, CAR-CAR-GAR-CAR-CAR- |
| CAR-CAR, CAR-CAR-CAR-GAR-CAR-CAR-CAR, CAR-CAR-CAR-CAR-GAR- |
| CAR-CAR, CAR-CAR-CAR-CAR-CAR-GAR-CAR |
| Oligonucleotides of peptide motifs containing 3-7 amino acide residues with Q(Glutamine) as the major constituent and H(Histidine) as the minor constituent |
| CAR-CAR-CAY, CAY-CAR-CAR, CAR-CAY-CAR, CAR-CAR-CAR-CAY, CAY- |
| CAR-CAR-CAR, CAR-CAY-CAR-CAR, CAR-CAR-CAY-CAR, CAR-CAR-CAR- |
| CAR-CAY, CAY-CAR-CAR-CAR-CAR, CAR-CAY-CAR-CAR-CAR, CAR-CAR- |
| CAY-CAR-CAR, CAR-CAR-CAR-CAY-CAR, CAR-CAR-CAR-CAY-CAY, CAY- |
| CAY-CAR-CAR-CAR, CAY-CAR-CAY-CAR-CAR, CAY-CAR-CAR-CAY-CAR, |
| CAY-CAR-CAR-CAR-CAY, CAR-CAY-CAY-CAR-CAR, CAR-CAY-CAR-CAY- |
| CAR, CAR-CAY-CAR-CAR-CAY, CAR-CAR-CAY-CAY-CAR, CAR-CAR-CAY- |
| CAR-CAY, CAR-CAR-CAR-CAR-CAR-CAY, CAY-CAR-CAR-CAR-CAR-CAR, |
| CAR-CAY-CAR-CAR-CAR-CAR, CAR-CAR-CAY-CAR-CAR-CAR, CAR-CAR- |
| CAR-CAY-CAR-CAR, CAR-CAR-CAR-CAR-CAY-CAR, CAR-CAR-CAR-CAR- |
| CAY-CAY, CAY-CAY-CAR-CAR-CAR-CAR, CAY-CAR-CAY-CAR-CAR-CAR, |
| CAY-CAR-CAR-CAY-CAR-CAR, CAY-CAR-CAR-CAR-CAY-CAR, CAY-CAR- |
| CAR-CAR-CAR-CAY, CAR-CAY-CAY-CAR-CAR-CAR, CAR-CAY-CAR-CAY- |
| CAR-CAR, CAR-CAY-CAR-CAR-CAY-CAR, CAR-CAY-CAR-CAR-CAR-CAY, |

TABLE 7-continued

| (SEQ ID NOS: 2482-4747, respectively, in order of appearance) |
|---|

CAR-CAR-CAY-CAY-CAR-CAR, CAR-CAR-CAY-CAR-CAY-CAR, CAR-CAR-CAY-CAR-CAR-CAY, CAR-CAR-CAR-CAY-CAY-CAR, CAR-CAR-CAR-CAY-CAR-CAY, CAR-CAR-CAR-CAR-CAY-CAY-CAY, CAY-CAY-CAY-CAR-CAR-CAR-CAR, CAY-CAR-CAY-CAY-CAR-CAR-CAR, CAY-CAR-CAY-CAR-CAY-CAR-CAR, CAY-CAR-CAY-CAR-CAR-CAY-CAR, CAY-CAR-CAY-CAR-CAR-CAR-CAY, CAY-CAR-CAR-CAY-CAY-CAR-CAR, CAY-CAR-CAR-CAY-CAR-CAY-CAR, CAY-CAR-CAR-CAY-CAR-CAR-CAY, CAY-CAR-CAR-CAR-CAY-CAR-CAY, CAY-CAR-CAR-CAR-CAY-CAY-CAR, CAY-CAR-CAR-CAR-CAR-CAY-CAY, CAY-CAY-CAR-CAY-CAR-CAR-CAR, CAY-CAY-CAR-CAR-CAY-CAR-CAR, CAY-CAY-CAR-CAR-CAR-CAY-CAR, CAY-CAY-CAR-CAR-CAR-CAR-CAY, CAR-CAY-CAY-CAY-CAR-CAR-CAR, CAR-CAY-CAY-CAR-CAY-CAR-CAR, CAR-CAY-CAY-CAR-CAR-CAY-CAR, CAR-CAY-CAY-CAR-CAR-CAR-CAY, CAR-CAY-CAR-CAY-CAY-CAR-CAR, CAR-CAY-CAR-CAR-CAY-CAY-CAR, CAR-CAY-CAR-CAR-CAR-CAY-CAY, CAR-CAY-CAR-CAY-CAR-CAY-CAR, CAR-CAY-CAR-CAY-CAR-CAR-CAY, CAR-CAY-CAR-CAR-CAY-CAR-CAY, CAR-CAR-CAY-CAY-CAY-CAR-CAR, CAR-CAR-CAY-CAY-CAR-CAY-CAR, CAR-CAR-CAY-CAY-CAR-CAR-CAY, CAR-CAR-CAY-CAR-CAY-CAY-CAR, CAR-CAR-CAY-CAR-CAY-CAR-CAY, CAR-CAR-CAY-CAR-CAR-CAY-CAY, CAR-CAR-CAR-CAY-CAY-CAY-CAR, CAR-CAR-CAR-CAY-CAY-CAR-CAY, CAR-CAR-CAR-CAY-CAR-CAY-CAY, CAR-CAR-CAR-CAR-CAR-CAY-CAY, CAY-CAY-CAR-CAR-CAR-CAR-CAR, CAY-CAR-CAY-CAR-CAR-CAR-CAR, CAY-CAR-CAR-CAY-CAR-CAR-CAR, CAY-CAR-CAR-CAR-CAY-CAR-CAR, CAY-CAR-CAR-CAR-CAR-CAY-CAR, CAY-CAR-CAR-CAR-CAR-CAR-CAY, CAR-CAY-CAY-CAR-CAR-CAR-CAR, CAR-CAY-CAR-CAY-CAR-CAR-CAR, CAR-CAY-CAR-CAR-CAY-CAR-CAR, CAR-CAY-CAR-CAR-CAR-CAY-CAR, CAR-CAY-CAR-CAR-CAR-CAR-CAY, CAR-CAR-CAY-CAY-CAR-CAR-CAR, CAR-CAR-CAY-CAR-CAY-CAR-CAR, CAR-CAR-CAY-CAR-CAR-CAY-CAR, CAR-CAR-CAY-CAR-CAR-CAR-CAY, CAR-CAR-CAR-CAY-CAY-CAR-CAR, CAR-CAR-CAR-CAY-CAR-CAY-CAR, CAR-CAR-CAR-CAY-CAR-CAR-CAY, CAR-CAR-CAR-CAR-CAY-CAY-CAR, CAR-CAR-CAR-CAR-CAY-CAR-CAY-CAR-CAR-CAR-CAR-CAR-CAR-CAY, CAY-CAR-CAR-CAR-CAR-CAR-CAR, CAR-CAY-CAR-CAR-CAR-CAR-CAR, CAR-CAR-CAY-CAR-CAR-CAR-CAR, CAR-CAR-CAR-CAY-CAR-CAR-CAR, CAR-CAR-CAR-CAR-CAY-CAR-CAR, CAR-CAR-CAR-CAR-CAR-CAY-CAR

Oligonucleotides of peptide motifs containing 3-7 amino acide residues with Q(Glutamine) as the major constituent and N(Asparagine) as the minor constituent CAR-CAR-AAY, AAY-CAR-CAR, CAR-AAY-CAR, CAR-CAR-CAR-AAY, AAY-CAR-CAR-CAR, CAR-AAY-CAR-CAR, CAR-CAR-AAY-CAR, CAR-CAR-CAR- TABLE 7-continued

| (SEQ ID NOS: 2482-4747, respectively, in order of appearance) |
|---|
| CAR-AAY, AAY-CAR-CAR-CAR-CAR, CAR-AAY-CAR-CAR-CAR, CAR-CAR-AAY-CAR-CAR, CAR-CAR-CAR-AAY-CAR, CAR-CAR-CAR-AAY-AAY, AAY-AAY-CAR-CAR-CAR, AAY-CAR-AAY-CAR-CAR, AAY-CAR-CAR-AAY-CAR, AAY-CAR-CAR-CAR-AAY, CAR-AAY-AAY-CAR-CAR, CAR-AAY-CAR-AAY-CAR, CAR-AAY-CAR-CAR-AAY, CAR-CAR-AAY-AAY-CAR, CAR-CAR-AAY-CAR-AAY, CAR-CAR-CAR-CAR-CAR-AAY, AAY-CAR-CAR-CAR-CAR-CAR, CAR-AAY-CAR-CAR-CAR-CAR, CAR-CAR-AAY-CAR-CAR-CAR, CAR-CAR-CAR-AAY-CAR-CAR, CAR-CAR-CAR-CAR-AAY-CAR, CAR-CAR-CAR-CAR-AAY-AAY, AAY-AAY-CAR-CAR-CAR-CAR, AAY-CAR-AAY-CAR-CAR-CAR, AAY-CAR-CAR-AAY-CAR-CAR, AAY-CAR-CAR-CAR-AAY-CAR, AAY-CAR-CAR-CAR-CAR-AAY, CAR-AAY-AAY-CAR-CAR-CAR, CAR-AAY-CAR-AAY-CAR-CAR, CAR-AAY-CAR-CAR-AAY-CAR, CAR-AAY-CAR-CAR-CAR-AAY, CAR-CAR-AAY-AAY-CAR-CAR, CAR-CAR-AAY-CAR-AAY-CAR, CAR-CAR-AAY-CAR-CAR-AAY, CAR-CAR-CAR-AAY-AAY-CAR, CAR-CAR-CAR-AAY-CAR-AAY, CAR-CAR-CAR-CAR-AAY-AAY-AAY, AAY-AAY-AAY-CAR-CAR-CAR-CAR, AAY-CAR-AAY-AAY-CAR-CAR-CAR, AAY-CAR-AAY-CAR-AAY-CAR-CAR, AAY-CAR-AAY-CAR-CAR-AAY-CAR, AAY-CAR-AAY-CAR-CAR-CAR-AAY, AAY-CAR-CAR-AAY-AAY-CAR-CAR, AAY-CAR-CAR-AAY-CAR-AAY-CAR, AAY-CAR-CAR-AAY-CAR-CAR-AAY, AAY-CAR-CAR-CAR-AAY-CAR-AAY, AAY-CAR-CAR-CAR-AAY-AAY-CAR, AAY-CAR-CAR-CAR-CAR-AAY-AAY, AAY-AAY-CAR-AAY-CAR-CAR-CAR, AAY-AAY-CAR-CAR-AAY-CAR-CAR, AAY-AAY-CAR-CAR-CAR-AAY-CAR, AAY-AAY-CAR-CAR-CAR-CAR-AAY, CAR-AAY-AAY-AAY-CAR-CAR-CAR, CAR-AAY-AAY-CAR-AAY-CAR-CAR, CAR-AAY-AAY-CAR-CAR-AAY-CAR, CAR-AAY-AAY-CAR-CAR-CAR-AAY, CAR-AAY-CAR-AAY-AAY-CAR-CAR, CAR-AAY-CAR-CAR-AAY-AAY-CAR, CAR-AAY-CAR-CAR-CAR-AAY-AAY, CAR-AAY-CAR-AAY-CAR-AAY-CAR, CAR-AAY-CAR-AAY-CAR-CAR-AAY, CAR-AAY-CAR-CAR-AAY-CAR-AAY, CAR-CAR-AAY-AAY-AAY-CAR-CAR, CAR-CAR-AAY-AAY-CAR-AAY-CAR, CAR-CAR-AAY-AAY-CAR-CAR-AAY, CAR-CAR-AAY-CAR-AAY-AAY-CAR, CAR-CAR-AAY-CAR-AAY-CAR-AAY, CAR-CAR-AAY-CAR-CAR-AAY-AAY, CAR-CAR-CAR-AAY-AAY-AAY-CAR, CAR-CAR-CAR-AAY-AAY-CAR-AAY, CAR-CAR-CAR-AAY-CAR-AAY-AAY, CAR-CAR-CAR-CAR-CAR-AAY-AAY, AAY-AAY-CAR-CAR-CAR-CAR-CAR, AAY-CAR-AAY-CAR-CAR-CAR-CAR, AAY-CAR-CAR-AAY-CAR-CAR-CAR, AAY-CAR-CAR-CAR-AAY-CAR-CAR, AAY-CAR-CAR-CAR-CAR-AAY-CAR, AAY-CAR-CAR-CAR-CAR-CAR-AAY, CAR-AAY-AAY-CAR-CAR-CAR-CAR, CAR-AAY-CAR-AAY-CAR-CAR-CAR, CAR-AAY-CAR-CAR-AAY-CAR-CAR, CAR-AAY-CAR-CAR-CAR-AAY-CAR, CAR-AAY-CAR-CAR-CAR-CAR-AAY, CAR-CAR-AAY-AAY-CAR-CAR-CAR, CAR-CAR-AAY-CAR-AAY-CAR-CAR, CAR-CAR-AAY-CAR-CAR- |

TABLE 7-continued

| (SEQ ID NOS: 2482-4747, respectively, in order of appearance) |
|---|
| AAY-CAR, CAR-CAR-AAY-CAR-CAR-CAR-AAY, CAR-CAR-CAR-AAY-AAY-CAR-CAR, CAR-CAR-CAR-AAY-CAR-AAY-CAR, CAR-CAR-CAR-AAY-CAR-CAR-AAY, CAR-CAR-CAR-CAR-AAY-AAY-CAR, CAR-CAR-CAR-CAR-AAY-CAR-AAY-CAR-CAR-CAR-CAR-CAR-CAR-AAY, AAY-CAR-CAR-CAR-CAR-CAR-CAR, CAR-AAY-CAR-CAR-CAR-CAR-CAR, CAR-CAR-AAY-CAR-CAR-CAR-CAR, CAR-CAR-CAR-AAY-CAR-CAR-CAR, CAR-CAR-CAR-CAR-AAY-CAR-CAR, CAR-CAR-CAR-CAR-CAR-AAY-CAR |
| Oligonucleotides of peptide motifs containing 3-7 amino acide residues with Q(Glutamine) as the major constituent and D(Aspartic Acid) as the minor constituent |
| CAR-CAR-GAY, GAY-CAR-CAR, CAR-GAY-CAR, CAR-CAR-CAR-GAY, GAY-CAR-CAR-CAR, CAR-GAY-CAR-CAR, CAR-CAR-GAY-CAR, CAR-CAR-CAR-CAR-GAY, GAY-CAR-CAR-CAR-CAR, CAR-GAY-CAR-CAR-CAR, CAR-CAR-GAY-CAR-CAR, CAR-CAR-CAR-GAY-CAR, CAR-CAR-CAR-GAY-GAY, GAY-GAY-CAR-CAR-CAR, GAY-CAR-GAY-CAR-CAR, GAY-CAR-CAR-GAY-CAR, GAY-CAR-CAR-CAR-GAY, CAR-GAY-GAY-CAR-CAR, CAR-GAY-CAR-GAY-CAR, CAR-GAY-CAR-CAR-GAY, CAR-CAR-GAY-GAY-CAR, CAR-CAR-GAY-CAR-GAY, CAR-CAR-CAR-CAR-CAR-GAY, GAY-CAR-CAR-CAR-CAR-CAR, CAR-GAY-CAR-CAR-CAR-CAR, CAR-CAR-GAY-CAR-CAR-CAR, CAR-CAR-CAR-GAY-CAR-CAR, CAR-CAR-CAR-CAR-GAY-CAR, CAR-CAR-CAR-CAR-GAY-GAY, GAY-GAY-CAR-CAR-CAR-CAR, GAY-CAR-GAY-CAR-CAR-CAR, GAY-CAR-CAR-GAY-CAR-CAR, GAY-CAR-CAR-CAR-GAY-CAR, GAY-CAR-CAR-CAR-CAR-GAY, CAR-GAY-GAY-CAR-CAR-CAR, CAR-GAY-CAR-GAY-CAR-CAR, CAR-GAY-CAR-CAR-GAY-CAR, CAR-GAY-CAR-CAR-CAR-GAY, CAR-CAR-GAY-GAY-CAR-CAR, CAR-CAR-GAY-CAR-GAY-CAR, CAR-CAR-GAY-CAR-CAR-GAY, CAR-CAR-CAR-GAY-GAY-CAR, CAR-CAR-CAR-GAY-CAR-GAY, CAR-CAR-CAR-CAR-GAY-GAY-GAY, GAY-GAY-GAY-CAR-CAR-CAR-CAR, GAY-CAR-GAY-GAY-CAR-CAR-CAR, GAY-CAR-GAY-CAR-GAY-CAR-CAR, GAY-CAR-GAY-CAR-CAR-GAY-CAR, GAY-CAR-GAY-CAR-CAR-CAR-GAY, GAY-CAR-CAR-GAY-GAY-CAR-CAR, GAY-CAR-CAR-GAY-CAR-GAY-CAR, GAY-CAR-CAR-GAY-CAR-CAR-GAY, GAY-CAR-CAR-CAR-GAY-CAR-GAY, GAY-CAR-CAR-CAR-GAY-GAY-CAR, GAY-CAR-CAR-CAR-CAR-GAY-GAY, GAY-GAY-CAR-GAY-CAR-CAR-CAR, GAY-GAY-CAR-CAR-GAY-CAR-CAR, GAY-GAY-CAR-CAR-CAR-GAY-CAR, GAY-GAY-CAR-CAR-CAR-CAR-GAY, CAR-GAY-GAY-GAY-CAR-CAR-CAR, CAR-GAY-GAY-CAR-GAY-CAR-CAR, CAR-GAY-GAY-CAR-CAR-GAY-CAR, CAR-GAY-GAY-CAR-CAR-CAR-GAY, CAR-GAY-CAR-GAY-GAY-CAR-CAR, CAR-GAY-CAR-CAR-GAY-GAY-CAR, CAR-GAY-CAR-CAR-CAR-GAY-GAY, CAR-GAY-CAR-GAY-CAR-GAY-CAR, CAR-GAY-CAR-GAY-CAR-CAR-GAY, CAR-GAY-CAR-CAR-GAY- |

TABLE 7-continued

| (SEQ ID NOS: 2482-4747, respectively, in order of appearance) |
|---|
| CAR-GAY, CAR-CAR-GAY-GAY-GAY-CAR-CAR, CAR-CAR-GAY-GAY-CAR-GAY-CAR, CAR-CAR-GAY-GAY-CAR-CAR-GAY, CAR-CAR-GAY-CAR-GAY-GAY-CAR, CAR-CAR-GAY-CAR-GAY-CAR-GAY, CAR-CAR-GAY-CAR-CAR-GAY-GAY, CAR-CAR-CAR-GAY-GAY-GAY-CAR, CAR-CAR-CAR-GAY-GAY-CAR-GAY, CAR-CAR-CAR-GAY-CAR-GAY-GAY, CAR-CAR-CAR-CAR-CAR-GAY-GAY, GAY-GAY-CAR-CAR-CAR-CAR-CAR, GAY-CAR-GAY-CAR-CAR-CAR-CAR, GAY-CAR-CAR-GAY-CAR-CAR-CAR, GAY-CAR-CAR-CAR-GAY-CAR-CAR, GAY-CAR-CAR-CAR-CAR-GAY-CAR, GAY-CAR-CAR-CAR-CAR-GAY, CAR-GAY-GAY-CAR-CAR-CAR-CAR, CAR-GAY-CAR-GAY-CAR-CAR-CAR, CAR-GAY-CAR-CAR-GAY-CAR-CAR, CAR-GAY-CAR-CAR-CAR-GAY-CAR, CAR-GAY-CAR-CAR-CAR-CAR-GAY, CAR-CAR-GAY-GAY-CAR-CAR-CAR, CAR-CAR-GAY-CAR-GAY-CAR-CAR, CAR-CAR-GAY-CAR-CAR-GAY-CAR, CAR-CAR-GAY-CAR-CAR-CAR-GAY, CAR-CAR-CAR-GAY-GAY-CAR-CAR, CAR-CAR-CAR-GAY-CAR-GAY-CAR, CAR-CAR-CAR-GAY-CAR-CAR-GAY, CAR-CAR-CAR-CAR-GAY-GAY-CAR, CAR-CAR-CAR-CAR-GAY-CAR-GAY-CAR-CAR-CAR-CAR-CAR-GAY, GAY-CAR-CAR-CAR-CAR-CAR-CAR, CAR-GAY-CAR-CAR-CAR-CAR-CAR, CAR-CAR-GAY-CAR-CAR-CAR-CAR, CAR-CAR-CAR-GAY-CAR-CAR-CAR, CAR-CAR-CAR-CAR-GAY-CAR-CAR, CAR-CAR-CAR-CAR-CAR-GAY-CAR |

TABLE 8

| Symbol | | Origin of designation |
|---|---|---|
| a | a | adenine |
| g | g | guanine |
| c | c | cytosine |
| t | t | thymine |
| u | u | uracil |
| r | g or a | purine |
| y | t/u or c | pyrimidine |
| m | a or c | amino |
| k | g or t/u | keto |
| s | g or c | strong interactions 3H-bonds |
| w | a or t/u | weak interactions 2H-bonds |
| b | g or c or t/u | not a |
| d | a or g or t/u | not c |
| h | a or c or t/u | not g |
| v | a or g or c | not t, not u |
| n | a or g or c or t/u, unknown, or other | any |

TABLE 9

((NNT)$_{155}$ disclosed as SEQ ID NO: 2)

| Code Construct | Admin Dose° μg/kg | AUC$_\infty$ ng* h/mL | T last h | AUC/D h*kg* ng/mL/μg | $t_{1/2}$ h | Cl mL/h/kg | $V_{ss}$ mL/kg | MRT$_\infty$ h | Dose normalized AUC$_\infty$$^§$ ng* h/mL |
|---|---|---|---|---|---|---|---|---|---|
| NNT$_{155}$ | 2.6 | 274.5 | 24 | 105.6 | 6.2 | 9.5 | 78.2 | 8.2 | 316.7 |
| C-GSF Control (A) | 3.2 | 20.91 | 8 | 6.53 | 1.53 | 153.0 | 160.1 | 1.0 | 19.60 |
| NEUPOGEN*[30] | 3.0 | 47.01 | 8 | 15.7 | 1.13 | 63.8 | 77.0 | 1.2 | 47.01 |
| NEULASTA | 6.0 | 116.4 | 24 | 19.4 | 3.04 | 51.5 | 266.1 | 5.2 | 58.20 |

SEQUENCE LISTING (4748 sequences)

SEQ ID NO: 1 - protein, 65 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNN

SEQ ID NO: 2 - protein, 155 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNN

SEQ ID NO: 3 - protein, 62 aa, Artificial Sequence
  Description of Artificial Sequence: Synthetic peptide
NNNNNTNNNNNTNNNNNTNNNNNTNNNNNTNNNNNTNNNNNTNNNNNTNNNNNTNNNNNTNN

SEQ ID NO: 4 - protein, 225 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 5 - protein, 228 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 6 - protein, 231 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 7 - protein, 234 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 8 - protein, 237 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 9 - protein, 240 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 10 - protein, 243 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 11 - protein, 246 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 12 - protein, 249 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 13 - protein, 252 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 14 - protein, 255 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 15 - protein, 258 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 16 - protein, 261 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 17 - protein, 264 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 18 - protein, 267 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 19 - protein, 270 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 20 - protein, 273 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 21 - protein, 276 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 22 - protein, 279 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 23 - protein, 282 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 24 - protein, 285 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 25 - protein, 288 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 26 - protein, 291 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 27 - protein, 294 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 28 - protein, 297 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 29 - protein, 300 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 30 - protein, 303 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 31 - protein, 306 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 32 - protein, 309 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 33 - protein, 312 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 34 - protein, 315 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 35 - protein, 318 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 36 - protein, 321 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 37 - protein, 324 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 38 - protein, 327 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 39 - protein, 330 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 40 - protein, 333 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 41 - protein, 336 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 42 - protein, 339 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 43 - protein, 342 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 44 - protein, 345 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 45 - protein, 348 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 46 - protein, 351 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 47 - protein, 354 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 48 - protein, 357 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 49 - protein, 360 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 50 - protein, 363 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 51 - protein, 366 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 52 - protein, 369 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 53 - protein, 372 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 54 - protein, 375 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 55 - protein, 378 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 56 - protein, 381 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 57 - protein, 384 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 58 - protein, 387 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 59 - protein, 390 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 60 - protein, 393 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 61 - protein, 396 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 62 - protein, 399 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 63 - protein, 402 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 64 - protein, 405 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 65 - protein, 408 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 66 - protein, 411 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 67 - protein, 414 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 68 - protein, 417 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 69 - protein, 420 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 70 - protein, 423 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 71 - protein, 426 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 72 - protein, 429 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 73 - protein, 432 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 74 - protein, 435 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 75 - protein, 438 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 76 - protein, 441 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 77 - protein, 444 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 78 - protein, 447 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 79 - protein, 450 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 80 - protein, 453 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 81 - protein, 456 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 82 - protein, 459 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 83 - protein, 462 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 84 - protein, 468 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 85 - protein, 471 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 86 - protein, 474 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 87 - protein, 477 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 88 - protein, 480 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 89 - protein, 483 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 90 - protein, 486 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 91 - protein, 489 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 92 - protein, 492 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 93 - protein, 495 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 94 - protein, 498 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 95 - protein, 501 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 96 - protein, 504 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 97 - protein, 507 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 98 - protein, 510 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 99 - protein, 513 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 100 - protein, 516 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 101 - protein, 519 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 102 - protein, 522 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 103 - protein, 525 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 104 - protein, 528 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 105 - protein, 531 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 106 - protein, 534 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 107 - protein, 537 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 108 - protein, 540 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 109 - protein, 543 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 110 - protein, 546 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 111 - protein, 549 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 112 - protein, 552 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 113 - protein, 555 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 114 - protein, 558 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 115 - protein, 561 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 116 - protein, 564 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 117 - protein, 567 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 118 - protein, 570 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 119 - protein, 573 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 120 - protein, 576 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 121 - protein, 579 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 122 - protein, 582 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 123 - protein, 585 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 124 - protein, 588 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 125 - protein, 591 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 126 - protein, 594 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 127 - protein, 597 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 128 - protein, 600 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 129 - protein, 603 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 130 - protein, 606 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 131 - protein, 609 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 132 - protein, 612 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 133 - protein, 615 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 134 - protein, 618 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 135 - protein, 621 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 136 - protein, 624 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 137 - protein, 627 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 138 - protein, 630 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 139 - protein, 633 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 140 - protein, 636 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 141 - protein, 639 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 142 - protein, 642 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 143 - protein, 645 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 144 - protein, 648 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 145 - protein, 651 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 146 - protein, 654 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 147 - protein, 657 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 148 - protein, 660 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 149 - protein, 663 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 150 - protein, 666 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 151 - protein, 669 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 152 - protein, 672 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 153 - protein, 675 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

SEQ ID NO: 154 - protein, 18 aa, Artificial Sequence
  Description of Artificial Sequence: Synthetic peptide
MFLQNLFLGFLAVVCANA

SEQ ID NO: 155 - DNA, 37 bp, Artificial Sequence
  Description of Artificial Sequence: Synthetic oligonucleotide
ggccgccatatgttcttgcaaaatttattccttggct

SEQ ID NO: 156 - DNA, 39 bp, Artificial Sequence
  Description of Artificial Sequence: Synthetic oligonucleotide
ccaaaaagccaaggaataaattttgcaagaacatatggc

SEQ ID NO: 157 - DNA, 37 bp, Artificial Sequence
  Description of Artificial Sequence: Synthetic oligonucleotide
ttttggccgttgtttgcgcaaacgcgtcccgcaggtg

SEQ ID NO: 158 - DNA, 35 bp, Artificial Sequence
  Description of Artificial Sequence: Synthetic oligonucleotide
gatccacctgcgggacgcgtttgcgcaaacaacgg

SEQ ID NO: 159 - DNA, 39 bp, Artificial Sequence
  Description of Artificial Sequence: Synthetic oligonucleotide
cgatcgacctgcaagtcgcgactccgctgggtccagcta

SEQ ID NO: 160 - DNA, 39 bp, Artificial Sequence
  Description of Artificial Sequence: Synthetic oligonucleotide
cgggatccgaagacgtgttgttaggctgggcaaggtggc

SEQ ID NO: 161 - DNA, 27 bp, Artificial Sequence
  Description of Artificial Sequence: Synthetic oligonucleotide
caacaccaacaataccaacaatacaaa

SEQ ID NO: 162 - DNA, 27 bp, Artificial Sequence
  Description of Artificial Sequence: Synthetic oligonucleotide
gttgtttgtattgttggtattgttggt

SEQ ID NO: 163 - DNA, 13 bp, Artificial Sequence
  Description of Artificial Sequence: Synthetic oligonucleotide
caactagtcttcg

SEQ ID NO: 164 - DNA, 13 bp, Artificial Sequence
  Description of Artificial Sequence: Synthetic oligonucleotide
gatccgaagacta

SEQ ID NO: 165 - protein, 9 aa, Artificial Sequence
  Description of Artificial Sequence: Synthetic peptide
NTNNTNNTN

SEQ ID NO: 166 - DNA, 27 bp, Artificial Sequence
  Description of Artificial Sequence: Synthetic oligonucleotide
caacaccaacaataccaacaatacaaa

SEQ ID NO: 167 - DNA, 27 bp, Artificial Sequence
  Description of Artificial Sequence: Synthetic oligonucleotide
gttgtttgtattgttggtattgttggt

SEQ ID NO: 168 - DNA, 13 bp, Artificial Sequence
  Description of Artificial Sequence: Synthetic oligonucleotide
caactagtcttcg

SEQ ID NO: 169 - DNA, 13 bp, Artificial Sequence
  Description of Artificial Sequence: Synthetic oligonucleotide
gatccgaagacta

SEQ ID NO: 170 - DNA, 27 bp, Artificial Sequence
  Description of Artificial Sequence: Synthetic oligonucleotide
caacaccaataataccaacaatacaaa

SEQ ID NO: 171 - DNA, 27 bp, Artificial Sequence
  Description of Artificial Sequence: Synthetic oligonucleotide
gttgtttgtattgttggtattattggt

SEQ ID NO: 172 - DNA, 13 bp, Artificial Sequence
  Description of Artificial Sequence: Synthetic oligonucleotide
caactagtcttcg

SEQ ID NO: 173 - DNA, 13 bp, Artificial Sequence
  Description of Artificial Sequence: Synthetic oligonucleotide
gatccgaagacta

SEQ ID NO: 174 - DNA, 27 bp, Artificial Sequence
  Description of Artificial Sequence: Synthetic oligonucleotide
caacaccaataataccaacaatacaaa

SEQ ID NO: 175 - DNA, 27 bp, Artificial Sequence
  Description of Artificial Sequence: Synthetic oligonucleotide
gttgtttgtattgttggtattattggt

SEQ ID NO: 176 - DNA, 13 bp, Artificial Sequence
  Description of Artificial Sequence: Synthetic oligonucleotide
caactagtcttcg

SEQ ID NO: 177 - DNA, 13 bp, Artificial Sequence
  Description of Artificial Sequence: Synthetic oligonucleotide
gatccgaagacta

SEQ ID NO: 178 - DNA, 29 bp, Artificial Sequence
  Description of Artificial Sequence: Synthetic oligonucleotide
ggctctagatattaatagtaatcaattac

SEQ ID NO: 179 - DNA, 26 bp, Artificial Sequence
  Description of Artificial Sequence: Synthetic oligonucleotide
cctcacgcatgcaccatggtaatagc

SEQ ID NO: 180 - DNA, 24 bp, Artificial Sequence
  Description of Artificial Sequence: Synthetic oligonucleotide
ggtgcatgcgtgaggctccggtgc

SEQ ID NO: 181 - DNA, 28 bp, Artificial Sequence
  Description of Artificial Sequence: Synthetic oligonucleotide
gtagttttcacggtacctgaaatggaag

SEQ ID NO: 182 - protein, 5 aa, Artificial Sequence
  Description of Artificial Sequence: Synthetic peptide
NNNNT

SEQ ID NO: 183 - protein, 6 aa, Artificial Sequence
  Description of Artificial Sequence: Synthetic peptide
NNNNNT

SEQ ID NO: 184 - protein, 4 aa, Artificial Sequence
  Description of Artificial Sequence: Synthetic peptide
NNNT

SEQ ID NO: 185 - protein, 4 aa, Artificial Sequence
  Description of Artificial Sequence: Synthetic peptide
TNNN

SEQ ID NO: 186 - protein, 4 aa, Artificial Sequence
  Description of Artificial Sequence: Synthetic peptide
NTNN

SEQ ID NO: 187 - protein, 4 aa, Artificial Sequence
  Description of Artificial Sequence: Synthetic peptide
NNTN

SEQ ID NO: 188 - protein, 5 aa, Artificial Sequence
  Description of Artificial Sequence: Synthetic peptide
NNNNT

SEQ ID NO: 189 - protein, 5 aa, Artificial Sequence
  Description of Artificial Sequence: Synthetic peptide
TNNNN

SEQ ID NO: 190 - protein, 5 aa, Artificial Sequence
  Description of Artificial Sequence: Synthetic peptide
NTNNN

SEQ ID NO: 191 - protein, 5 aa, Artificial Sequence
  Description of Artificial Sequence: Synthetic peptide
NNTNN

SEQ ID NO: 192 - protein, 5 aa, Artificial Sequence
  Description of Artificial Sequence: Synthetic peptide
NNNTN

SEQ ID NO: 193 - protein, 5 aa, Artificial Sequence
  Description of Artificial Sequence: Synthetic peptide
NNNTT

SEQ ID NO: 194 - protein, 5 aa, Artificial Sequence
  Description of Artificial Sequence: Synthetic peptide
TTNNN

SEQ ID NO: 195 - protein, 5 aa, Artificial Sequence
  Description of Artificial Sequence: Synthetic peptide
TNTNN

SEQ ID NO: 196 - protein, 5 aa, Artificial Sequence
  Description of Artificial Sequence: Synthetic peptide
TNNTN

SEQ ID NO: 197 - protein, 5 aa, Artificial Sequence
  Description of Artificial Sequence: Synthetic peptide
TNNNT

SEQ ID NO: 198 - protein, 5 aa, Artificial Sequence
  Description of Artificial Sequence: Synthetic peptide
NTTNN

SEQ ID NO: 199 - protein, 5 aa, Artificial Sequence
  Description of Artificial Sequence: Synthetic peptide
NTNTN

SEQ ID NO: 200 - protein, 5 aa, Artificial Sequence
  Description of Artificial Sequence: Synthetic peptide
NTNNT

SEQ ID NO: 201 - protein, 5 aa, Artificial Sequence
  Description of Artificial Sequence: Synthetic peptide
NNTTN

SEQ ID NO: 202 - protein, 5 aa, Artificial Sequence
  Description of Artificial Sequence: Synthetic peptide
NNTNT

SEQ ID NO: 203 - protein, 6 aa, Artificial Sequence
  Description of Artificial Sequence: Synthetic peptide
NNNNNT

SEQ ID NO: 204 - protein, 6 aa, Artificial Sequence
  Description of Artificial Sequence: Synthetic peptide
TNNNNN

SEQ ID NO: 205 - protein, 6 aa, Artificial Sequence
  Description of Artificial Sequence: Synthetic peptide
NTNNNN

SEQ ID NO: 206 - protein, 6 aa, Artificial Sequence
  Description of Artificial Sequence: Synthetic peptide
NNTNNN

SEQ ID NO: 207 - protein, 6 aa, Artificial Sequence
  Description of Artificial Sequence: Synthetic peptide
NNNTNN

SEQ ID NO: 208 - protein, 6 aa, Artificial Sequence
  Description of Artificial Sequence: Synthetic peptide
NNNNTN

SEQ ID NO: 209 - protein, 6 aa, Artificial Sequence
  Description of Artificial Sequence: Synthetic peptide
NNNNTT

SEQ ID NO: 210 - protein, 6 aa, Artificial Sequence
  Description of Artificial Sequence: Synthetic peptide
TTNNNN

SEQ ID NO: 211 - protein, 6 aa, Artificial Sequence
  Description of Artificial Sequence: Synthetic peptide
TNTNNN

SEQ ID NO: 212 - protein, 6 aa, Artificial Sequence
  Description of Artificial Sequence: Synthetic peptide
TNNTNN

SEQ ID NO: 213 - protein, 6 aa, Artificial Sequence
  Description of Artificial Sequence: Synthetic peptide
TNNNTN

SEQ ID NO: 214 - protein, 6 aa, Artificial Sequence
  Description of Artificial Sequence: Synthetic peptide
TNNNNT

SEQ ID NO: 215 - protein, 6 aa, Artificial Sequence
  Description of Artificial Sequence: Synthetic peptide
NTTNNN

SEQ ID NO: 216 - protein, 6 aa, Artificial Sequence
  Description of Artificial Sequence: Synthetic peptide
NTNTNN

SEQ ID NO: 217 - protein, 6 aa, Artificial Sequence
  Description of Artificial Sequence: Synthetic peptide
NTNNTN

SEQ ID NO: 218 - protein, 6 aa, Artificial Sequence
  Description of Artificial Sequence: Synthetic peptide
NTNNNT

SEQ ID NO: 219 - protein, 6 aa, Artificial Sequence
  Description of Artificial Sequence: Synthetic peptide
NNTTNN

SEQ ID NO: 220 - protein, 6 aa, Artificial Sequence
  Description of Artificial Sequence: Synthetic peptide
NNTNTN

SEQ ID NO: 221 - protein, 6 aa, Artificial Sequence
  Description of Artificial Sequence: Synthetic peptide
NNTNNT

SEQ ID NO: 222 - protein, 6 aa, Artificial Sequence
  Description of Artificial Sequence: Synthetic peptide
NNNTTN

SEQ ID NO: 223 - protein, 6 aa, Artificial Sequence
  Description of Artificial Sequence: Synthetic peptide
NNNTNT

SEQ ID NO: 224 - protein, 7 aa, Artificial Sequence
  Description of Artificial Sequence: Synthetic peptide
NNNNTTT

SEQ ID NO: 225 - protein, 7 aa, Artificial Sequence
  Description of Artificial Sequence: Synthetic peptide
TTTNNNN

SEQ ID NO: 226 - protein, 7 aa, Artificial Sequence
  Description of Artificial Sequence: Synthetic peptide
TNTTNNN

SEQ ID NO: 227 - protein, 7 aa, Artificial Sequence
  Description of Artificial Sequence: Synthetic peptide
TNTNTNN

SEQ ID NO: 228 - protein, 7 aa, Artificial Sequence
  Description of Artificial Sequence: Synthetic peptide
TNTNNTN

SEQ ID NO: 229 - protein, 7 aa, Artificial Sequence
  Description of Artificial Sequence: Synthetic peptide
TNTNNNT

SEQ ID NO: 230 - protein, 7 aa, Artificial Sequence
  Description of Artificial Sequence: Synthetic peptide
TNNTTNN

SEQ ID NO: 231 - protein, 7 aa, Artificial Sequence
  Description of Artificial Sequence: Synthetic peptide
TNNTNTN

SEQ ID NO: 232 - protein, 7 aa, Artificial Sequence
  Description of Artificial Sequence: Synthetic peptide
TNNTNNT

SEQ ID NO: 233 - protein, 7 aa, Artificial Sequence
  Description of Artificial Sequence: Synthetic peptide
TNNNTNT

SEQ ID NO: 234 - protein, 7 aa, Artificial Sequence
  Description of Artificial Sequence: Synthetic peptide
TNNNTTN

SEQ ID NO: 235 - protein, 7 aa, Artificial Sequence
  Description of Artificial Sequence: Synthetic peptide
TNNNNTT

SEQ ID NO: 236 - protein, 7 aa, Artificial Sequence
  Description of Artificial Sequence: Synthetic peptide
TTNTNNN

SEQ ID NO: 237 - protein, 7 aa, Artificial Sequence
  Description of Artificial Sequence: Synthetic peptide
TTNNTNN

SEQ ID NO: 238 - protein, 7 aa, Artificial Sequence
  Description of Artificial Sequence: Synthetic peptide
TTNNNTN

SEQ ID NO: 239 - protein, 7 aa, Artificial Sequence
  Description of Artificial Sequence: Synthetic peptide
TTNNNNT

SEQ ID NO: 240 - protein, 7 aa, Artificial Sequence
  Description of Artificial Sequence: Synthetic peptide
NTTTNNN

SEQ ID NO: 241 - protein, 7 aa, Artificial Sequence
  Description of Artificial Sequence: Synthetic peptide
NTTNTNN

SEQ ID NO: 242 - protein, 7 aa, Artificial Sequence
  Description of Artificial Sequence: Synthetic peptide
NTTNNTN

SEQ ID NO: 243 - protein, 7 aa, Artificial Sequence
  Description of Artificial Sequence: Synthetic peptide
NTTNNNT

SEQ ID NO: 244 - protein, 7 aa, Artificial Sequence
  Description of Artificial Sequence: Synthetic peptide
NTNTTNN

SEQ ID NO: 245 - protein, 7 aa, Artificial Sequence
  Description of Artificial Sequence: Synthetic peptide
NTNNTTN

SEQ ID NO: 246 - protein, 7 aa, Artificial Sequence
  Description of Artificial Sequence: Synthetic peptide
NTNNNTT

SEQ ID NO: 247 - protein, 7 aa, Artificial Sequence
  Description of Artificial Sequence: Synthetic peptide
NTNTNTN

SEQ ID NO: 248 - protein, 7 aa, Artificial Sequence
  Description of Artificial Sequence: Synthetic peptide
NTNTNNT

SEQ ID NO: 249 - protein, 7 aa, Artificial Sequence
  Description of Artificial Sequence: Synthetic peptide
NTNNTNT

SEQ ID NO: 250 - protein, 7 aa, Artificial Sequence
  Description of Artificial Sequence: Synthetic peptide
NNTTTNN

SEQ ID NO: 251 - protein, 7 aa, Artificial Sequence
  Description of Artificial Sequence: Synthetic peptide
NNTTNTN

SEQ ID NO: 252 - protein, 7 aa, Artificial Sequence
  Description of Artificial Sequence: Synthetic peptide
NNTTNNT

SEQ ID NO: 253 - protein, 7 aa, Artificial Sequence
  Description of Artificial Sequence: Synthetic peptide
NNTNTTN

SEQ ID NO: 254 - protein, 7 aa, Artificial Sequence
  Description of Artificial Sequence: Synthetic peptide
NNTNTNT

SEQ ID NO: 255 - protein, 7 aa, Artificial Sequence
  Description of Artificial Sequence: Synthetic peptide
NNTNNTT

SEQ ID NO: 256 - protein, 7 aa, Artificial Sequence
  Description of Artificial Sequence: Synthetic peptide
NNNTTTN

SEQ ID NO: 257 - protein, 7 aa, Artificial Sequence
  Description of Artificial Sequence: Synthetic peptide
NNNTTNT

SEQ ID NO: 258 - protein, 7 aa, Artificial Sequence
  Description of Artificial Sequence: Synthetic peptide
NNNTNTT

SEQ ID NO: 259 - protein, 7 aa, Artificial Sequence
  Description of Artificial Sequence: Synthetic peptide
NNNNNTT

SEQ ID NO: 260 - protein, 7 aa, Artificial Sequence
  Description of Artificial Sequence: Synthetic peptide
TTNNNNN

SEQ ID NO: 261 - protein, 7 aa, Artificial Sequence
  Description of Artificial Sequence: Synthetic peptide
TNTNNNN

SEQ ID NO: 262 - protein, 7 aa, Artificial Sequence
  Description of Artificial Sequence: Synthetic peptide
TNNTNNN

SEQ ID NO: 263 - protein, 7 aa, Artificial Sequence
  Description of Artificial Sequence: Synthetic peptide
TNNNTNN

SEQ ID NO: 264 - protein, 7 aa, Artificial Sequence
  Description of Artificial Sequence: Synthetic peptide
TNNNNTN

SEQ ID NO: 265 - protein, 7 aa, Artificial Sequence
  Description of Artificial Sequence: Synthetic peptide
TNNNNNT

SEQ ID NO: 266 - protein, 7 aa, Artificial Sequence
  Description of Artificial Sequence: Synthetic peptide
NTTNNNN

SEQ ID NO: 267 - protein, 7 aa, Artificial Sequence
  Description of Artificial Sequence: Synthetic peptide
NTNTNNN

SEQ ID NO: 268 - protein, 7 aa, Artificial Sequence
  Description of Artificial Sequence: Synthetic peptide
NTNNTNN

SEQ ID NO: 269 - protein, 7 aa, Artificial Sequence
  Description of Artificial Sequence: Synthetic peptide
NTNNNTN

SEQ ID NO: 270 - protein, 7 aa, Artificial Sequence
  Description of Artificial Sequence: Synthetic peptide
NTNNNNT

SEQ ID NO: 271 - protein, 7 aa, Artificial Sequence
  Description of Artificial Sequence: Synthetic peptide
NNTTNNN

SEQ ID NO: 272 - protein, 7 aa, Artificial Sequence
  Description of Artificial Sequence: Synthetic peptide
NNTNTNN

SEQ ID NO: 273 - protein, 7 aa, Artificial Sequence
  Description of Artificial Sequence: Synthetic peptide
NNTNNTN

SEQ ID NO: 274 - protein, 7 aa, Artificial Sequence
  Description of Artificial Sequence: Synthetic peptide
NNTNNNT

SEQ ID NO: 275 - protein, 7 aa, Artificial Sequence
  Description of Artificial Sequence: Synthetic peptide
NNNTTNN

SEQ ID NO: 276 - protein, 7 aa, Artificial Sequence
  Description of Artificial Sequence: Synthetic peptide
NNNTNTN

SEQ ID NO: 277 - protein, 7 aa, Artificial Sequence
  Description of Artificial Sequence: Synthetic peptide
NNNTNNT

SEQ ID NO: 278 - protein, 7 aa, Artificial Sequence
  Description of Artificial Sequence: Synthetic peptide
NNNNTTN

SEQ ID NO: 279 - protein, 7 aa, Artificial Sequence
  Description of Artificial Sequence: Synthetic peptide
NNNNTNT

SEQ ID NO: 280 - protein, 7 aa, Artificial Sequence
  Description of Artificial Sequence: Synthetic peptide
NNNNNNT

SEQ ID NO: 281 - protein, 7 aa, Artificial Sequence
  Description of Artificial Sequence: Synthetic peptide
TNNNNNN

SEQ ID NO: 282 - protein, 7 aa, Artificial Sequence
  Description of Artificial Sequence: Synthetic peptide
NTNNNNN

SEQ ID NO: 283 - protein, 7 aa, Artificial Sequence
  Description of Artificial Sequence: Synthetic peptide
NNTNNNN

SEQ ID NO: 284 - protein, 7 aa, Artificial Sequence
  Description of Artificial Sequence: Synthetic peptide
NNNTNNN

SEQ ID NO: 285 - protein, 7 aa, Artificial Sequence
  Description of Artificial Sequence: Synthetic peptide
NNNNTNN

SEQ ID NO: 286 - protein, 7 aa, Artificial Sequence
  Description of Artificial Sequence: Synthetic peptide
NNNNNTN

SEQ ID NO: 287 - protein, 4 aa, Artificial Sequence
  Description of Artificial Sequence: Synthetic peptide
NNNA

SEQ ID NO: 288 - protein, 4 aa, Artificial Sequence
  Description of Artificial Sequence: Synthetic peptide
ANNN

SEQ ID NO: 289 - protein, 4 aa, Artificial Sequence
  Description of Artificial Sequence: Synthetic peptide
NANN

SEQ ID NO: 290 - protein, 4 aa, Artificial Sequence
  Description of Artificial Sequence: Synthetic peptide
NNAN

SEQ ID NO: 291 - protein, 5 aa, Artificial Sequence
  Description of Artificial Sequence: Synthetic peptide
NNNNA

SEQ ID NO: 292 - protein, 5 aa, Artificial Sequence
  Description of Artificial Sequence: Synthetic peptide
ANNNN

SEQ ID NO: 293 - protein, 5 aa, Artificial Sequence
  Description of Artificial Sequence: Synthetic peptide
NANNN

SEQ ID NO: 294 - protein, 5 aa, Artificial Sequence
  Description of Artificial Sequence: Synthetic peptide
NNANN

SEQ ID NO: 295 - protein, 5 aa, Artificial Sequence
  Description of Artificial Sequence: Synthetic peptide
NNNAN

SEQ ID NO: 296 - protein, 5 aa, Artificial Sequence
  Description of Artificial Sequence: Synthetic peptide
NNNAA

SEQ ID NO: 297 - protein, 5 aa, Artificial Sequence
  Description of Artificial Sequence: Synthetic peptide
AANNN

SEQ ID NO: 298 - protein, 5 aa, Artificial Sequence
  Description of Artificial Sequence: Synthetic peptide
ANANN

SEQ ID NO: 299 - protein, 5 aa, Artificial Sequence
  Description of Artificial Sequence: Synthetic peptide
ANNAN

SEQ ID NO: 300 - protein, 5 aa, Artificial Sequence
  Description of Artificial Sequence: Synthetic peptide
ANNNA

SEQ ID NO: 301 - protein, 5 aa, Artificial Sequence
  Description of Artificial Sequence: Synthetic peptide
NAANN

SEQ ID NO: 302 - protein, 5 aa, Artificial Sequence
  Description of Artificial Sequence: Synthetic peptide
NANAN

SEQ ID NO: 303 - protein, 5 aa, Artificial Sequence
  Description of Artificial Sequence: Synthetic peptide
NANNA

SEQ ID NO: 304 - protein, 5 aa, Artificial Sequence
  Description of Artificial Sequence: Synthetic peptide
NNAAN

SEQ ID NO: 305 - protein, 5 aa, Artificial Sequence
  Description of Artificial Sequence: Synthetic peptide
NNANA

SEQ ID NO: 306 - protein, 6 aa, Artificial Sequence
  Description of Artificial Sequence: Synthetic peptide
NNNNNA

SEQ ID NO: 307 - protein, 6 aa, Artificial Sequence
  Description of Artificial Sequence: Synthetic peptide
ANNNNN

SEQ ID NO: 308 - protein, 6 aa, Artificial Sequence
  Description of Artificial Sequence: Synthetic peptide
NANNNN

SEQ ID NO: 309 - protein, 6 aa, Artificial Sequence
  Description of Artificial Sequence: Synthetic peptide
NNANNN

SEQ ID NO: 310 - protein, 6 aa, Artificial Sequence
  Description of Artificial Sequence: Synthetic peptide
NNNANN

SEQ ID NO: 311 - protein, 6 aa, Artificial Sequence
  Description of Artificial Sequence: Synthetic peptide
NNNNAN

SEQ ID NO: 312 - protein, 6 aa, Artificial Sequence
  Description of Artificial Sequence: Synthetic peptide
NNNNAA

SEQ ID NO: 313 - protein, 6 aa, Artificial Sequence
  Description of Artificial Sequence: Synthetic peptide
AANNNN

SEQ ID NO: 314 - protein, 6 aa, Artificial Sequence
  Description of Artificial Sequence: Synthetic peptide
ANANNN

SEQ ID NO: 315 - protein, 6 aa, Artificial Sequence
  Description of Artificial Sequence: Synthetic peptide
ANNANN

SEQ ID NO: 316 - protein, 6 aa, Artificial Sequence
  Description of Artificial Sequence: Synthetic peptide
ANNNAN

SEQ ID NO: 317 - protein, 6 aa, Artificial Sequence
  Description of Artificial Sequence: Synthetic peptide
ANNNNA

SEQ ID NO: 318 - protein, 6 aa, Artificial Sequence
  Description of Artificial Sequence: Synthetic peptide
NAANNN

SEQ ID NO: 319 - protein, 6 aa, Artificial Sequence
  Description of Artificial Sequence: Synthetic peptide
NANANN

SEQ ID NO: 320 - protein, 6 aa, Artificial Sequence
  Description of Artificial Sequence: Synthetic peptide
NANNAN

SEQ ID NO: 321 - protein, 6 aa, Artificial Sequence
  Description of Artificial Sequence: Synthetic peptide
NANNNA

SEQ ID NO: 322 - protein, 6 aa, Artificial Sequence
  Description of Artificial Sequence: Synthetic peptide
NNAANN

SEQ ID NO: 323 - protein, 6 aa, Artificial Sequence
  Description of Artificial Sequence: Synthetic peptide
NNANAN

SEQ ID NO: 324 - protein, 6 aa, Artificial Sequence
  Description of Artificial Sequence: Synthetic peptide
NNANNA

SEQ ID NO: 325 - protein, 6 aa, Artificial Sequence
  Description of Artificial Sequence: Synthetic peptide
NNNAAN

SEQ ID NO: 326 - protein, 6 aa, Artificial Sequence
  Description of Artificial Sequence: Synthetic peptide
NNNANA

SEQ ID NO: 327 - protein, 7 aa, Artificial Sequence
  Description of Artificial Sequence: Synthetic peptide
NNNNAAA

SEQ ID NO: 328 - protein, 7 aa, Artificial Sequence
  Description of Artificial Sequence: Synthetic peptide
AAANNNN

SEQ ID NO: 329 - protein, 7 aa, Artificial Sequence
  Description of Artificial Sequence: Synthetic peptide
ANAANNN

SEQ ID NO: 330 - protein, 7 aa, Artificial Sequence
  Description of Artificial Sequence: Synthetic peptide
ANANANN

SEQ ID NO: 331 - protein, 7 aa, Artificial Sequence
  Description of Artificial Sequence: Synthetic peptide
ANANNAN

SEQ ID NO: 332 - protein, 7 aa, Artificial Sequence
  Description of Artificial Sequence: Synthetic peptide
ANANNNA

SEQ ID NO: 333 - protein, 7 aa, Artificial Sequence
  Description of Artificial Sequence: Synthetic peptide
ANNAANN

SEQ ID NO: 334 - protein, 7 aa, Artificial Sequence
  Description of Artificial Sequence: Synthetic peptide
ANNANAN

SEQ ID NO: 335 - protein, 7 aa, Artificial Sequence
  Description of Artificial Sequence: Synthetic peptide
ANNANNA

SEQ ID NO: 336 - protein, 7 aa, Artificial Sequence
  Description of Artificial Sequence: Synthetic peptide
ANNNANA

SEQ ID NO: 337 - protein, 7 aa, Artificial Sequence
  Description of Artificial Sequence: Synthetic peptide
ANNNAAN

SEQ ID NO: 338 - protein, 7 aa, Artificial Sequence
  Description of Artificial Sequence: Synthetic peptide
ANNNNAA

SEQ ID NO: 339 - protein, 7 aa, Artificial Sequence
  Description of Artificial Sequence: Synthetic peptide
AANANNN

SEQ ID NO: 340 - protein, 7 aa, Artificial Sequence
  Description of Artificial Sequence: Synthetic peptide
AANNANN

SEQ ID NO: 341 - protein, 7 aa, Artificial Sequence
  Description of Artificial Sequence: Synthetic peptide
AANNNAN

SEQ ID NO: 342 - protein, 7 aa, Artificial Sequence
  Description of Artificial Sequence: Synthetic peptide
AANNNNA

SEQ ID NO: 343 - protein, 7 aa, Artificial Sequence
  Description of Artificial Sequence: Synthetic peptide
NAAANNN

SEQ ID NO: 344 - protein, 7 aa, Artificial Sequence
  Description of Artificial Sequence: Synthetic peptide
NAANANN

SEQ ID NO: 345 - protein, 7 aa, Artificial Sequence
  Description of Artificial Sequence: Synthetic peptide
NAANNAN

SEQ ID NO: 346 - protein, 7 aa, Artificial Sequence
  Description of Artificial Sequence: Synthetic peptide
NAANNNA

SEQ ID NO: 347 - protein, 7 aa, Artificial Sequence
  Description of Artificial Sequence: Synthetic peptide
NANAANN

SEQ ID NO: 348 - protein, 7 aa, Artificial Sequence
  Description of Artificial Sequence: Synthetic peptide
NANNAAN

SEQ ID NO: 349 - protein, 7 aa, Artificial Sequence
  Description of Artificial Sequence: Synthetic peptide
NANNNAA

SEQ ID NO: 350 - protein, 7 aa, Artificial Sequence
  Description of Artificial Sequence: Synthetic peptide
NANANAN

SEQ ID NO: 351 - protein, 7 aa, Artificial Sequence
  Description of Artificial Sequence: Synthetic peptide
NANANNA

SEQ ID NO: 352 - protein, 7 aa, Artificial Sequence
  Description of Artificial Sequence: Synthetic peptide
NANNANA

SEQ ID NO: 353 - protein, 7 aa, Artificial Sequence
  Description of Artificial Sequence: Synthetic peptide
NNAAANN

SEQ ID NO: 354 - protein, 7 aa, Artificial Sequence
  Description of Artificial Sequence: Synthetic peptide
NNAANAN

SEQ ID NO: 355 - protein, 7 aa, Artificial Sequence
  Description of Artificial Sequence: Synthetic peptide
NNAANNA

SEQ ID NO: 356 - protein, 7 aa, Artificial Sequence
  Description of Artificial Sequence: Synthetic peptide
NNANAAN

SEQ ID NO: 357 - protein, 7 aa, Artificial Sequence
  Description of Artificial Sequence: Synthetic peptide
NNANANA

SEQ ID NO: 358 - protein, 7 aa, Artificial Sequence
  Description of Artificial Sequence: Synthetic peptide
NNANNAA

SEQ ID NO: 359 - protein, 7 aa, Artificial Sequence
  Description of Artificial Sequence: Synthetic peptide
NNNAAAN

SEQ ID NO: 360 - protein, 7 aa, Artificial Sequence
  Description of Artificial Sequence: Synthetic peptide
NNNAANA

SEQ ID NO: 361 - protein, 7 aa, Artificial Sequence
  Description of Artificial Sequence: Synthetic peptide
NNNANAA

SEQ ID NO: 362 - protein, 7 aa, Artificial Sequence
  Description of Artificial Sequence: Synthetic peptide
NNNNNAA

SEQ ID NO: 363 - protein, 7 aa, Artificial Sequence
  Description of Artificial Sequence: Synthetic peptide
AANNNNN

SEQ ID NO: 364 - protein, 7 aa, Artificial Sequence
  Description of Artificial Sequence: Synthetic peptide
ANANNNN

SEQ ID NO: 365 - protein, 7 aa, Artificial Sequence
  Description of Artificial Sequence: Synthetic peptide
ANNANNN

SEQ ID NO: 366 - protein, 7 aa, Artificial Sequence
  Description of Artificial Sequence: Synthetic peptide
ANNNANN

SEQ ID NO: 367 - protein, 7 aa, Artificial Sequence
  Description of Artificial Sequence: Synthetic peptide
ANNNNAN

SEQ ID NO: 368 - protein, 7 aa, Artificial Sequence
  Description of Artificial Sequence: Synthetic peptide
ANNNNNA

SEQ ID NO: 369 - protein, 7 aa, Artificial Sequence
  Description of Artificial Sequence: Synthetic peptide
NAANNNN

SEQ ID NO: 370 - protein, 7 aa, Artificial Sequence
  Description of Artificial Sequence: Synthetic peptide
NANANNN

SEQ ID NO: 371 - protein, 7 aa, Artificial Sequence
  Description of Artificial Sequence: Synthetic peptide
NANNANN

SEQ ID NO: 372 - protein, 7 aa, Artificial Sequence
  Description of Artificial Sequence: Synthetic peptide
NANNNAN

SEQ ID NO: 373 - protein, 7 aa, Artificial Sequence
  Description of Artificial Sequence: Synthetic peptide
NANNNNA

SEQ ID NO: 374 - protein, 7 aa, Artificial Sequence
  Description of Artificial Sequence: Synthetic peptide
NNAANNN

SEQ ID NO: 375 - protein, 7 aa, Artificial Sequence
  Description of Artificial Sequence: Synthetic peptide
NNANANN

SEQ ID NO: 376 - protein, 7 aa, Artificial Sequence
  Description of Artificial Sequence: Synthetic peptide
NNANNAN

SEQ ID NO: 377 - protein, 7 aa, Artificial Sequence
  Description of Artificial Sequence: Synthetic peptide
NNANNNA

SEQ ID NO: 378 - protein, 7 aa, Artificial Sequence
  Description of Artificial Sequence: Synthetic peptide
NNNAANN

SEQ ID NO: 379 - protein, 7 aa, Artificial Sequence
  Description of Artificial Sequence: Synthetic peptide
NNNANAN

SEQ ID NO: 380 - protein, 7 aa, Artificial Sequence
  Description of Artificial Sequence: Synthetic peptide
NNNANNA

SEQ ID NO: 381 - protein, 7 aa, Artificial Sequence
  Description of Artificial Sequence: Synthetic peptide
NNNNAAN

SEQ ID NO: 382 - protein, 7 aa, Artificial Sequence
  Description of Artificial Sequence: Synthetic peptide
NNNNANA

SEQ ID NO: 383 - protein, 7 aa, Artificial Sequence
  Description of Artificial Sequence: Synthetic peptide
NNNNNNA

SEQ ID NO: 384 - protein, 7 aa, Artificial Sequence
  Description of Artificial Sequence: Synthetic peptide
ANNNNNN

SEQ ID NO: 385 - protein, 7 aa, Artificial Sequence
  Description of Artificial Sequence: Synthetic peptide
NANNNNN

SEQ ID NO: 386 - protein, 7 aa, Artificial Sequence
  Description of Artificial Sequence: Synthetic peptide
NNANNNN

SEQ ID NO: 387 - protein, 7 aa, Artificial Sequence
  Description of Artificial Sequence: Synthetic peptide
NNNANNN

SEQ ID NO: 388 - protein, 7 aa, Artificial Sequence
  Description of Artificial Sequence: Synthetic peptide
NNNNANN

SEQ ID NO: 389 - protein, 7 aa, Artificial Sequence
  Description of Artificial Sequence: Synthetic peptide
NNNNNAN

SEQ ID NO: 390 - protein, 4 aa, Artificial Sequence
  Description of Artificial Sequence: Synthetic peptide
NNNS

SEQ ID NO: 391 - protein, 4 aa, Artificial Sequence
  Description of Artificial Sequence: Synthetic peptide
SNNN

SEQ ID NO: 392 - protein, 4 aa, Artificial Sequence
  Description of Artificial Sequence: Synthetic peptide
NSNN

SEQ ID NO: 393 - protein, 4 aa, Artificial Sequence
  Description of Artificial Sequence: Synthetic peptide
NNSN

SEQ ID NO: 394 - protein, 5 aa, Artificial Sequence
  Description of Artificial Sequence: Synthetic peptide
NNNNS

SEQ ID NO: 395 - protein, 5 aa, Artificial Sequence
  Description of Artificial Sequence: Synthetic peptide
SNNNN

SEQ ID NO: 396 - protein, 5 aa, Artificial Sequence
  Description of Artificial Sequence: Synthetic peptide
NSNNN

SEQ ID NO: 397 - protein, 5 aa, Artificial Sequence
  Description of Artificial Sequence: Synthetic peptide
NNSNN

SEQ ID NO: 398 - protein, 5 aa, Artificial Sequence
  Description of Artificial Sequence: Synthetic peptide
NNNSN

SEQ ID NO: 399 - protein, 5 aa, Artificial Sequence
  Description of Artificial Sequence: Synthetic peptide
NNNSS

SEQ ID NO: 400 - protein, 5 aa, Artificial Sequence
  Description of Artificial Sequence: Synthetic peptide
SSNNN

SEQ ID NO: 401 - protein, 5 aa, Artificial Sequence
  Description of Artificial Sequence: Synthetic peptide
SNSNN

SEQ ID NO: 402 - protein, 5 aa, Artificial Sequence
  Description of Artificial Sequence: Synthetic peptide
SNNSN

SEQ ID NO: 403 - protein, 5 aa, Artificial Sequence
  Description of Artificial Sequence: Synthetic peptide
SNNNS

SEQ ID NO: 404 - protein, 5 aa, Artificial Sequence
  Description of Artificial Sequence: Synthetic peptide
NSSNN

SEQ ID NO: 405 - protein, 5 aa, Artificial Sequence
  Description of Artificial Sequence: Synthetic peptide
NSNSN

SEQ ID NO: 406 - protein, 5 aa, Artificial Sequence
  Description of Artificial Sequence: Synthetic peptide
NSNNS

SEQ ID NO: 407 - protein, 5 aa, Artificial Sequence
  Description of Artificial Sequence: Synthetic peptide
NNSSN

SEQ ID NO: 408 - protein, 5 aa, Artificial Sequence
  Description of Artificial Sequence: Synthetic peptide
NNSNS

SEQ ID NO: 409 - protein, 6 aa, Artificial Sequence
  Description of Artificial Sequence: Synthetic peptide
NNNNNS

SEQ ID NO: 410 - protein, 6 aa, Artificial Sequence
  Description of Artificial Sequence: Synthetic peptide
SNNNNN

SEQ ID NO: 411 - protein, 6 aa, Artificial Sequence
  Description of Artificial Sequence: Synthetic peptide
NSNNNN

SEQ ID NO: 412 - protein, 6 aa, Artificial Sequence
  Description of Artificial Sequence: Synthetic peptide
NNSNNN

SEQ ID NO: 413 - protein, 6 aa, Artificial Sequence
  Description of Artificial Sequence: Synthetic peptide
NNNSNN

SEQ ID NO: 414 - protein, 6 aa, Artificial Sequence
  Description of Artificial Sequence: Synthetic peptide
NNNNSN

SEQ ID NO: 415 - protein, 6 aa, Artificial Sequence
  Description of Artificial Sequence: Synthetic peptide
NNNNSS

SEQ ID NO: 416 - protein, 6 aa, Artificial Sequence
  Description of Artificial Sequence: Synthetic peptide
SSNNNN

SEQ ID NO: 417 - protein, 6 aa, Artificial Sequence
  Description of Artificial Sequence: Synthetic peptide
SNSNNN

SEQ ID NO: 418 - protein, 6 aa, Artificial Sequence
  Description of Artificial Sequence: Synthetic peptide
SNNSNN

SEQ ID NO: 419 - protein, 6 aa, Artificial Sequence
  Description of Artificial Sequence: Synthetic peptide
SNNNSN

SEQ ID NO: 420 - protein, 6 aa, Artificial Sequence
  Description of Artificial Sequence: Synthetic peptide
SNNNNS

SEQ ID NO: 421 - protein, 6 aa, Artificial Sequence
  Description of Artificial Sequence: Synthetic peptide
NSSNNN

SEQ ID NO: 422 - protein, 6 aa, Artificial Sequence
  Description of Artificial Sequence: Synthetic peptide
NSNSNN

SEQ ID NO: 423 - protein, 6 aa, Artificial Sequence
  Description of Artificial Sequence: Synthetic peptide
NSNNSN

SEQ ID NO: 424 - protein, 6 aa, Artificial Sequence
  Description of Artificial Sequence: Synthetic peptide
NSNNNS

SEQ ID NO: 425 - protein, 6 aa, Artificial Sequence
  Description of Artificial Sequence: Synthetic peptide
NNSSNN

SEQ ID NO: 426 - protein, 6 aa, Artificial Sequence
  Description of Artificial Sequence: Synthetic peptide
NNSNSN

SEQ ID NO: 427 - protein, 6 aa, Artificial Sequence
  Description of Artificial Sequence: Synthetic peptide
NNSNNS

SEQ ID NO: 428 - protein, 6 aa, Artificial Sequence
  Description of Artificial Sequence: Synthetic peptide
NNNSSN

SEQ ID NO: 429 - protein, 6 aa, Artificial Sequence
  Description of Artificial Sequence: Synthetic peptide
NNNSNS

SEQ ID NO: 430 - protein, 7 aa, Artificial Sequence
  Description of Artificial Sequence: Synthetic peptide
NNNNSSS

SEQ ID NO: 431 - protein, 7 aa, Artificial Sequence
  Description of Artificial Sequence: Synthetic peptide
SSSNNNN

SEQ ID NO: 432 - protein, 7 aa, Artificial Sequence
  Description of Artificial Sequence: Synthetic peptide
SNSSNNN

SEQ ID NO: 433 - protein, 7 aa, Artificial Sequence
  Description of Artificial Sequence: Synthetic peptide
SNSNSNN

SEQ ID NO: 434 - protein, 7 aa, Artificial Sequence
  Description of Artificial Sequence: Synthetic peptide
SNSNNSN

SEQ ID NO: 435 - protein, 7 aa, Artificial Sequence
  Description of Artificial Sequence: Synthetic peptide
SNSNNNS

SEQ ID NO: 436 - protein, 7 aa, Artificial Sequence
  Description of Artificial Sequence: Synthetic peptide
SNNSSNN

SEQ ID NO: 437 - protein, 7 aa, Artificial Sequence
  Description of Artificial Sequence: Synthetic peptide
SNNSNSN

SEQ ID NO: 438 - protein, 7 aa, Artificial Sequence
  Description of Artificial Sequence: Synthetic peptide
SNNSNNS

SEQ ID NO: 439 - protein, 7 aa, Artificial Sequence
  Description of Artificial Sequence: Synthetic peptide
SNNNSNS

SEQ ID NO: 440 - protein, 7 aa, Artificial Sequence
  Description of Artificial Sequence: Synthetic peptide
SNNNSSN

SEQ ID NO: 441 - protein, 7 aa, Artificial Sequence
  Description of Artificial Sequence: Synthetic peptide
SNNNNSS

SEQ ID NO: 442 - protein, 7 aa, Artificial Sequence
  Description of Artificial Sequence: Synthetic peptide
SSNSNNN

SEQ ID NO: 443 - protein, 7 aa, Artificial Sequence
  Description of Artificial Sequence: Synthetic peptide
SSNNSNN

SEQ ID NO: 444 - protein, 7 aa, Artificial Sequence
  Description of Artificial Sequence: Synthetic peptide
SSNNNSN

SEQ ID NO: 445 - protein, 7 aa, Artificial Sequence
  Description of Artificial Sequence: Synthetic peptide
SSNNNNS

SEQ ID NO: 446 - protein, 7 aa, Artificial Sequence
  Description of Artificial Sequence: Synthetic peptide
NSSSNNN

SEQ ID NO: 447 - protein, 7 aa, Artificial Sequence
  Description of Artificial Sequence: Synthetic peptide
NSSNSNN

SEQ ID NO: 448 - protein, 7 aa, Artificial Sequence
  Description of Artificial Sequence: Synthetic peptide
NSSNNSN

SEQ ID NO: 449 - protein, 7 aa, Artificial Sequence
  Description of Artificial Sequence: Synthetic peptide
NSSNNNS

SEQ ID NO: 450 - protein, 7 aa, Artificial Sequence
  Description of Artificial Sequence: Synthetic peptide
NSNSSNN

SEQ ID NO: 451 - protein, 7 aa, Artificial Sequence
  Description of Artificial Sequence: Synthetic peptide
NSNNSSN

SEQ ID NO: 452 - protein, 7 aa, Artificial Sequence
  Description of Artificial Sequence: Synthetic peptide
NSNNNSS

SEQ ID NO: 453 - protein, 7 aa, Artificial Sequence
  Description of Artificial Sequence: Synthetic peptide
NSNSNSN

SEQ ID NO: 454 - protein, 7 aa, Artificial Sequence
  Description of Artificial Sequence: Synthetic peptide
NSNSNNS

SEQ ID NO: 455 - protein, 7 aa, Artificial Sequence
  Description of Artificial Sequence: Synthetic peptide
NSNNSNS

SEQ ID NO: 456 - protein, 7 aa, Artificial Sequence
  Description of Artificial Sequence: Synthetic peptide
NNSSSNN

SEQ ID NO: 457 - protein, 7 aa, Artificial Sequence
  Description of Artificial Sequence: Synthetic peptide
NNSSNSN

SEQ ID NO: 458 - protein, 7 aa, Artificial Sequence
  Description of Artificial Sequence: Synthetic peptide
NNSSNNS

SEQ ID NO: 459 - protein, 7 aa, Artificial Sequence
  Description of Artificial Sequence: Synthetic peptide
NNSNSSN

SEQ ID NO: 460 - protein, 7 aa, Artificial Sequence
  Description of Artificial Sequence: Synthetic peptide
NNSNSNS

SEQ ID NO: 461 - protein, 7 aa, Artificial Sequence
  Description of Artificial Sequence: Synthetic peptide
NNSNNSS

SEQ ID NO: 462 - protein, 7 aa, Artificial Sequence
  Description of Artificial Sequence: Synthetic peptide
NNNSSSN

SEQ ID NO: 463 - protein, 7 aa, Artificial Sequence
  Description of Artificial Sequence: Synthetic peptide
NNNSSNS

SEQ ID NO: 464 - protein, 7 aa, Artificial Sequence
  Description of Artificial Sequence: Synthetic peptide
NNNSNSS

SEQ ID NO: 465 - protein, 7 aa, Artificial Sequence
  Description of Artificial Sequence: Synthetic peptide
NNNNNSS

SEQ ID NO: 466 - protein, 7 aa, Artificial Sequence
  Description of Artificial Sequence: Synthetic peptide
SSNNNNN

SEQ ID NO: 467 - protein, 7 aa, Artificial Sequence
  Description of Artificial Sequence: Synthetic peptide
SNSNNNN

SEQ ID NO: 468 - protein, 7 aa, Artificial Sequence
  Description of Artificial Sequence: Synthetic peptide
SNNSNNN

SEQ ID NO: 469 - protein, 7 aa, Artificial Sequence
  Description of Artificial Sequence: Synthetic peptide
SNNNSNN

SEQ ID NO: 470 - protein, 7 aa, Artificial Sequence
  Description of Artificial Sequence: Synthetic peptide
SNNNNSN

SEQ ID NO: 471 - protein, 7 aa, Artificial Sequence
  Description of Artificial Sequence: Synthetic peptide
SNNNNNS

SEQ ID NO: 472 - protein, 7 aa, Artificial Sequence
  Description of Artificial Sequence: Synthetic peptide
NSSNNNN

SEQ ID NO: 473 - protein, 7 aa, Artificial Sequence
  Description of Artificial Sequence: Synthetic peptide
NSNSNNN

SEQ ID NO: 474 - protein, 7 aa, Artificial Sequence
  Description of Artificial Sequence: Synthetic peptide
NSNNSNN

SEQ ID NO: 475 - protein, 7 aa, Artificial Sequence
  Description of Artificial Sequence: Synthetic peptide
NSNNNSN

SEQ ID NO: 476 - protein, 7 aa, Artificial Sequence
  Description of Artificial Sequence: Synthetic peptide
NSNNNNS

SEQ ID NO: 477 - protein, 7 aa, Artificial Sequence
  Description of Artificial Sequence: Synthetic peptide
NNSSNNN

SEQ ID NO: 478 - protein, 7 aa, Artificial Sequence
  Description of Artificial Sequence: Synthetic peptide
NNSNSNN

SEQ ID NO: 479 - protein, 7 aa, Artificial Sequence
  Description of Artificial Sequence: Synthetic peptide
NNSNNSN

SEQ ID NO: 480 - protein, 7 aa, Artificial Sequence
  Description of Artificial Sequence: Synthetic peptide
NNSNNNS

SEQ ID NO: 481 - protein, 7 aa, Artificial Sequence
  Description of Artificial Sequence: Synthetic peptide
NNNSSNN

SEQ ID NO: 482 - protein, 7 aa, Artificial Sequence
  Description of Artificial Sequence: Synthetic peptide
NNNSNSN

SEQ ID NO: 483 - protein, 7 aa, Artificial Sequence
  Description of Artificial Sequence: Synthetic peptide
NNNSNNS

SEQ ID NO: 484 - protein, 7 aa, Artificial Sequence
  Description of Artificial Sequence: Synthetic peptide
NNNNSSN

SEQ ID NO: 485 - protein, 7 aa, Artificial Sequence
  Description of Artificial Sequence: Synthetic peptide
NNNNSNS

SEQ ID NO: 486 - protein, 7 aa, Artificial Sequence
  Description of Artificial Sequence: Synthetic peptide
NNNNNNS

SEQ ID NO: 487 - protein, 7 aa, Artificial Sequence
  Description of Artificial Sequence: Synthetic peptide
SNNNNNN

SEQ ID NO: 488 - protein, 7 aa, Artificial Sequence
  Description of Artificial Sequence: Synthetic peptide
NSNNNNN

SEQ ID NO: 489 - protein, 7 aa, Artificial Sequence
  Description of Artificial Sequence: Synthetic peptide
NNSNNNN

SEQ ID NO: 490 - protein, 7 aa, Artificial Sequence
  Description of Artificial Sequence: Synthetic peptide
NNNSNNN

SEQ ID NO: 491 - protein, 7 aa, Artificial Sequence
  Description of Artificial Sequence: Synthetic peptide
NNNNSNN

SEQ ID NO: 492 - protein, 7 aa, Artificial Sequence
  Description of Artificial Sequence: Synthetic peptide
NNNNNSN

SEQ ID NO: 493 - protein, 4 aa, Artificial Sequence
  Description of Artificial Sequence: Synthetic peptide
NNNQ

SEQ ID NO: 494 - protein, 4 aa, Artificial Sequence
  Description of Artificial Sequence: Synthetic peptide
QNNN

SEQ ID NO: 495 - protein, 4 aa, Artificial Sequence
  Description of Artificial Sequence: Synthetic peptide
NQNN

SEQ ID NO: 496 - protein, 4 aa, Artificial Sequence
  Description of Artificial Sequence: Synthetic peptide
NNQN

SEQ ID NO: 497 - protein, 5 aa, Artificial Sequence
  Description of Artificial Sequence: Synthetic peptide
NNNNQ

SEQ ID NO: 498 - protein, 5 aa, Artificial Sequence
  Description of Artificial Sequence: Synthetic peptide
QNNNN

SEQ ID NO: 499 - protein, 5 aa, Artificial Sequence
  Description of Artificial Sequence: Synthetic peptide
NQNNN

SEQ ID NO: 500 - protein, 5 aa, Artificial Sequence
  Description of Artificial Sequence: Synthetic peptide
NNQNN

SEQ ID NO: 501 - protein, 5 aa, Artificial Sequence
  Description of Artificial Sequence: Synthetic peptide
NNNQN

SEQ ID NO: 502 - protein, 5 aa, Artificial Sequence
  Description of Artificial Sequence: Synthetic peptide
NNNQQ

SEQ ID NO: 503 - protein, 5 aa, Artificial Sequence
  Description of Artificial Sequence: Synthetic peptide
QQNNN

SEQ ID NO: 504 - protein, 5 aa, Artificial Sequence
  Description of Artificial Sequence: Synthetic peptide
QNQNN

SEQ ID NO: 505 - protein, 5 aa, Artificial Sequence
  Description of Artificial Sequence: Synthetic peptide
QNNQN

SEQ ID NO: 506 - protein, 5 aa, Artificial Sequence
  Description of Artificial Sequence: Synthetic peptide
QNNNQ

SEQ ID NO: 507 - protein, 5 aa, Artificial Sequence
  Description of Artificial Sequence: Synthetic peptide
NQQNN

SEQ ID NO: 508 - protein, 5 aa, Artificial Sequence
  Description of Artificial Sequence: Synthetic peptide
NQNQN

SEQ ID NO: 509 - protein, 5 aa, Artificial Sequence
  Description of Artificial Sequence: Synthetic peptide
NQNNQ

SEQ ID NO: 510 - protein, 5 aa, Artificial Sequence
  Description of Artificial Sequence: Synthetic peptide
NNQQN

SEQ ID NO: 511 - protein, 5 aa, Artificial Sequence
  Description of Artificial Sequence: Synthetic peptide
NNQNQ

SEQ ID NO: 512 - protein, 6 aa, Artificial Sequence
  Description of Artificial Sequence: Synthetic peptide
NNNNNQ

SEQ ID NO: 513 - protein, 6 aa, Artificial Sequence
  Description of Artificial Sequence: Synthetic peptide
QNNNNN

SEQ ID NO: 514 - protein, 6 aa, Artificial Sequence
  Description of Artificial Sequence: Synthetic peptide
NQNNNN

SEQ ID NO: 515 - protein, 6 aa, Artificial Sequence
  Description of Artificial Sequence: Synthetic peptide
NNQNNN

SEQ ID NO: 516 - protein, 6 aa, Artificial Sequence
  Description of Artificial Sequence: Synthetic peptide
NNNQNN

SEQ ID NO: 517 - protein, 6 aa, Artificial Sequence
  Description of Artificial Sequence: Synthetic peptide
NNNNQN

SEQ ID NO: 518 - protein, 6 aa, Artificial Sequence
  Description of Artificial Sequence: Synthetic peptide
NNNNQQ

SEQ ID NO: 519 - protein, 6 aa, Artificial Sequence
  Description of Artificial Sequence: Synthetic peptide
QQNNNN

SEQ ID NO: 520 - protein, 6 aa, Artificial Sequence
  Description of Artificial Sequence: Synthetic peptide
QNQNNN

SEQ ID NO: 521 - protein, 6 aa, Artificial Sequence
  Description of Artificial Sequence: Synthetic peptide
QNNQNN

SEQ ID NO: 522 - protein, 6 aa, Artificial Sequence
  Description of Artificial Sequence: Synthetic peptide
QNNNQN

SEQ ID NO: 523 - protein, 6 aa, Artificial Sequence
  Description of Artificial Sequence: Synthetic peptide
QNNNNQ

SEQ ID NO: 524 - protein, 6 aa, Artificial Sequence
  Description of Artificial Sequence: Synthetic peptide
NQQNNN

SEQ ID NO: 525 - protein, 6 aa, Artificial Sequence
  Description of Artificial Sequence: Synthetic peptide
NQNQNN

SEQ ID NO: 526 - protein, 6 aa, Artificial Sequence
  Description of Artificial Sequence: Synthetic peptide
NQNNQN

SEQ ID NO: 527 - protein, 6 aa, Artificial Sequence
  Description of Artificial Sequence: Synthetic peptide
NQNNNQ

SEQ ID NO: 528 - protein, 6 aa, Artificial Sequence
  Description of Artificial Sequence: Synthetic peptide
NNQQNN

SEQ ID NO: 529 - protein, 6 aa, Artificial Sequence
  Description of Artificial Sequence: Synthetic peptide
NNQNQN

SEQ ID NO: 530 - protein, 6 aa, Artificial Sequence
  Description of Artificial Sequence: Synthetic peptide
NNQNNQ

SEQ ID NO: 531 - protein, 6 aa, Artificial Sequence
  Description of Artificial Sequence: Synthetic peptide
NNNQQN

SEQ ID NO: 532 - protein, 6 aa, Artificial Sequence
  Description of Artificial Sequence: Synthetic peptide
NNNQNQ

SEQ ID NO: 533 - protein, 7 aa, Artificial Sequence
  Description of Artificial Sequence: Synthetic peptide
NNNNQQQ

SEQ ID NO: 534 - protein, 7 aa, Artificial Sequence
  Description of Artificial Sequence: Synthetic peptide
QQQNNNN

SEQ ID NO: 535 - protein, 7 aa, Artificial Sequence
  Description of Artificial Sequence: Synthetic peptide
QNQQNNN

SEQ ID NO: 536 - protein, 7 aa, Artificial Sequence
  Description of Artificial Sequence: Synthetic peptide
QNQNQNN

SEQ ID NO: 537 - protein, 7 aa, Artificial Sequence
  Description of Artificial Sequence: Synthetic peptide
QNQNNQN

SEQ ID NO: 538 - protein, 7 aa, Artificial Sequence
  Description of Artificial Sequence: Synthetic peptide
QNQNNNQ

SEQ ID NO: 539 - protein, 7 aa, Artificial Sequence
  Description of Artificial Sequence: Synthetic peptide
QNNQQNN

SEQ ID NO: 540 - protein, 7 aa, Artificial Sequence
  Description of Artificial Sequence: Synthetic peptide
QNNQNQN

SEQ ID NO: 541 - protein, 7 aa, Artificial Sequence
  Description of Artificial Sequence: Synthetic peptide
QNNQNNQ

SEQ ID NO: 542 - protein, 7 aa, Artificial Sequence
  Description of Artificial Sequence: Synthetic peptide
QNNNQNQ

SEQ ID NO: 543 - protein, 7 aa, Artificial Sequence
  Description of Artificial Sequence: Synthetic peptide
QNNNQQN

SEQ ID NO: 544 - protein, 7 aa, Artificial Sequence
  Description of Artificial Sequence: Synthetic peptide
QNNNNQQ

SEQ ID NO: 545 - protein, 7 aa, Artificial Sequence
  Description of Artificial Sequence: Synthetic peptide
QQNQNNN

SEQ ID NO: 546 - protein, 7 aa, Artificial Sequence
  Description of Artificial Sequence: Synthetic peptide
QQNNQNN

SEQ ID NO: 547 - protein, 7 aa, Artificial Sequence
  Description of Artificial Sequence: Synthetic peptide
QQNNNQN

SEQ ID NO: 548 - protein, 7 aa, Artificial Sequence
  Description of Artificial Sequence: Synthetic peptide
QQNNNNQ

SEQ ID NO: 549 - protein, 7 aa, Artificial Sequence
  Description of Artificial Sequence: Synthetic peptide
NQQQNNN

SEQ ID NO: 550 - protein, 7 aa, Artificial Sequence
  Description of Artificial Sequence: Synthetic peptide
NQQNQNN

SEQ ID NO: 551 - protein, 7 aa, Artificial Sequence
  Description of Artificial Sequence: Synthetic peptide
NQQNNQN

SEQ ID NO: 552 - protein, 7 aa, Artificial Sequence
  Description of Artificial Sequence: Synthetic peptide
NQQNNNQ

SEQ ID NO: 553 - protein, 7 aa, Artificial Sequence
  Description of Artificial Sequence: Synthetic peptide
NQNQQNN

SEQ ID NO: 554 - protein, 7 aa, Artificial Sequence
  Description of Artificial Sequence: Synthetic peptide
NQNNQQN

SEQ ID NO: 555 - protein, 7 aa, Artificial Sequence
  Description of Artificial Sequence: Synthetic peptide
NQNNNQQ

SEQ ID NO: 556 - protein, 7 aa, Artificial Sequence
  Description of Artificial Sequence: Synthetic peptide
NQNQNQN

SEQ ID NO: 557 - protein, 7 aa, Artificial Sequence
  Description of Artificial Sequence: Synthetic peptide
NQNQNNQ

SEQ ID NO: 558 - protein, 7 aa, Artificial Sequence
  Description of Artificial Sequence: Synthetic peptide
NQNNQNQ

SEQ ID NO: 559 - protein, 7 aa, Artificial Sequence
  Description of Artificial Sequence: Synthetic peptide
NNQQQNN

SEQ ID NO: 560 - protein, 7 aa, Artificial Sequence
  Description of Artificial Sequence: Synthetic peptide
NNQQNQN

SEQ ID NO: 561 - protein, 7 aa, Artificial Sequence
  Description of Artificial Sequence: Synthetic peptide
NNQQNNQ

SEQ ID NO: 562 - protein, 7 aa, Artificial Sequence
  Description of Artificial Sequence: Synthetic peptide
NNQNQQN

SEQ ID NO: 563 - protein, 7 aa, Artificial Sequence
  Description of Artificial Sequence: Synthetic peptide
NNQNQNQ

SEQ ID NO: 564 - protein, 7 aa, Artificial Sequence
  Description of Artificial Sequence: Synthetic peptide
NNQNNQQ

SEQ ID NO: 565 - protein, 7 aa, Artificial Sequence
  Description of Artificial Sequence: Synthetic peptide
NNNQQQN

SEQ ID NO: 566 - protein, 7 aa, Artificial Sequence
  Description of Artificial Sequence: Synthetic peptide
NNNQQNQ

SEQ ID NO: 567 - protein, 7 aa, Artificial Sequence
  Description of Artificial Sequence: Synthetic peptide
NNNQNQQ

SEQ ID NO: 568 - protein, 7 aa, Artificial Sequence
  Description of Artificial Sequence: Synthetic peptide
NNNNNQQ

SEQ ID NO: 569 - protein, 7 aa, Artificial Sequence
  Description of Artificial Sequence: Synthetic peptide
QQNNNNN

SEQ ID NO: 570 - protein, 7 aa, Artificial Sequence
  Description of Artificial Sequence: Synthetic peptide
QNQNNNN

SEQ ID NO: 571 - protein, 7 aa, Artificial Sequence
  Description of Artificial Sequence: Synthetic peptide
QNNQNNN

SEQ ID NO: 572 - protein, 7 aa, Artificial Sequence
  Description of Artificial Sequence: Synthetic peptide
QNNNQNN

SEQ ID NO: 573 - protein, 7 aa, Artificial Sequence
  Description of Artificial Sequence: Synthetic peptide
QNNNNQN

SEQ ID NO: 574 - protein, 7 aa, Artificial Sequence
  Description of Artificial Sequence: Synthetic peptide
QNNNNNQ

SEQ ID NO: 575 - protein, 7 aa, Artificial Sequence
  Description of Artificial Sequence: Synthetic peptide
NQQNNNN

SEQ ID NO: 576 - protein, 7 aa, Artificial Sequence
  Description of Artificial Sequence: Synthetic peptide
NQNQNNN

SEQ ID NO: 577 - protein, 7 aa, Artificial Sequence
  Description of Artificial Sequence: Synthetic peptide
NQNNQNN

SEQ ID NO: 578 - protein, 7 aa, Artificial Sequence
  Description of Artificial Sequence: Synthetic peptide
NQNNNQN

SEQ ID NO: 579 - protein, 7 aa, Artificial Sequence
  Description of Artificial Sequence: Synthetic peptide
NQNNNNQ

SEQ ID NO: 580 - protein, 7 aa, Artificial Sequence
  Description of Artificial Sequence: Synthetic peptide
NNQQNNN

SEQ ID NO: 581 - protein, 7 aa, Artificial Sequence
  Description of Artificial Sequence: Synthetic peptide
NNQNQNN

SEQ ID NO: 582 - protein, 7 aa, Artificial Sequence
  Description of Artificial Sequence: Synthetic peptide
NNQNNQN

SEQ ID NO: 583 - protein, 7 aa, Artificial Sequence
  Description of Artificial Sequence: Synthetic peptide
NNQNNNQ

SEQ ID NO: 584 - protein, 7 aa, Artificial Sequence
  Description of Artificial Sequence: Synthetic peptide
NNNQQNN

SEQ ID NO: 585 - protein, 7 aa, Artificial Sequence
  Description of Artificial Sequence: Synthetic peptide
NNNQNQN

SEQ ID NO: 586 - protein, 7 aa, Artificial Sequence
  Description of Artificial Sequence: Synthetic peptide
NNNQNNQ

SEQ ID NO: 587 - protein, 7 aa, Artificial Sequence
  Description of Artificial Sequence: Synthetic peptide
NNNNQQN

SEQ ID NO: 588 - protein, 7 aa, Artificial Sequence
  Description of Artificial Sequence: Synthetic peptide
NNNNQNQ

SEQ ID NO: 589 - protein, 7 aa, Artificial Sequence
  Description of Artificial Sequence: Synthetic peptide
NNNNNNQ

SEQ ID NO: 590 - protein, 7 aa, Artificial Sequence
  Description of Artificial Sequence: Synthetic peptide
QNNNNNN

SEQ ID NO: 591 - protein, 7 aa, Artificial Sequence
  Description of Artificial Sequence: Synthetic peptide
NQNNNNN

SEQ ID NO: 592 - protein, 7 aa, Artificial Sequence
  Description of Artificial Sequence: Synthetic peptide
NNQNNNN

SEQ ID NO: 593 - protein, 7 aa, Artificial Sequence
  Description of Artificial Sequence: Synthetic peptide
NNNQNNN

SEQ ID NO: 594 - protein, 7 aa, Artificial Sequence
  Description of Artificial Sequence: Synthetic peptide
NNNNQNN

SEQ ID NO: 595 - protein, 7 aa, Artificial Sequence
  Description of Artificial Sequence: Synthetic peptide
NNNNNQN

SEQ ID NO: 596 - protein, 4 aa, Artificial Sequence
  Description of Artificial Sequence: Synthetic peptide
NNNE

SEQ ID NO: 597 - protein, 4 aa, Artificial Sequence
  Description of Artificial Sequence: Synthetic peptide
ENNN

SEQ ID NO: 598 - protein, 4 aa, Artificial Sequence
  Description of Artificial Sequence: Synthetic peptide
NENN

SEQ ID NO: 599 - protein, 4 aa, Artificial Sequence
  Description of Artificial Sequence: Synthetic peptide
NNEN

SEQ ID NO: 600 - protein, 5 aa, Artificial Sequence
  Description of Artificial Sequence: Synthetic peptide
NNNNE

SEQ ID NO: 601 - protein, 5 aa, Artificial Sequence
  Description of Artificial Sequence: Synthetic peptide
ENNNN

SEQ ID NO: 602 - protein, 5 aa, Artificial Sequence
  Description of Artificial Sequence: Synthetic peptide
NENNN

SEQ ID NO: 603 - protein, 5 aa, Artificial Sequence
  Description of Artificial Sequence: Synthetic peptide
NNENN

SEQ ID NO: 604 - protein, 5 aa, Artificial Sequence
  Description of Artificial Sequence: Synthetic peptide
NNNEN

SEQ ID NO: 605 - protein, 5 aa, Artificial Sequence
  Description of Artificial Sequence: Synthetic peptide
NNNEE

SEQ ID NO: 606 - protein, 5 aa, Artificial Sequence
  Description of Artificial Sequence: Synthetic peptide
EENNN

SEQ ID NO: 607 - protein, 5 aa, Artificial Sequence
  Description of Artificial Sequence: Synthetic peptide
ENENN

SEQ ID NO: 608 - protein, 5 aa, Artificial Sequence
  Description of Artificial Sequence: Synthetic peptide
ENNEN

SEQ ID NO: 609 - protein, 5 aa, Artificial Sequence
  Description of Artificial Sequence: Synthetic peptide
ENNNE

SEQ ID NO: 610 - protein, 5 aa, Artificial Sequence
  Description of Artificial Sequence: Synthetic peptide
NEENN

SEQ ID NO: 611 - protein, 5 aa, Artificial Sequence
  Description of Artificial Sequence: Synthetic peptide
NENEN

SEQ ID NO: 612 - protein, 5 aa, Artificial Sequence
  Description of Artificial Sequence: Synthetic peptide
NENNE

SEQ ID NO: 613 - protein, 5 aa, Artificial Sequence
  Description of Artificial Sequence: Synthetic peptide
NNEEN

SEQ ID NO: 614 - protein, 5 aa, Artificial Sequence
  Description of Artificial Sequence: Synthetic peptide
NNENE

SEQ ID NO: 615 - protein, 6 aa, Artificial Sequence
  Description of Artificial Sequence: Synthetic peptide
NNNNNE

SEQ ID NO: 616 - protein, 6 aa, Artificial Sequence
  Description of Artificial Sequence: Synthetic peptide
ENNNNN

SEQ ID NO: 617 - protein, 6 aa, Artificial Sequence
  Description of Artificial Sequence: Synthetic peptide
NENNNN

SEQ ID NO: 618 - protein, 6 aa, Artificial Sequence
  Description of Artificial Sequence: Synthetic peptide
NNENNN

SEQ ID NO: 619 - protein, 6 aa, Artificial Sequence
  Description of Artificial Sequence: Synthetic peptide
NNNENN

SEQ ID NO: 620 - protein, 6 aa, Artificial Sequence
  Description of Artificial Sequence: Synthetic peptide
NNNNEN

SEQ ID NO: 621 - protein, 6 aa, Artificial Sequence
  Description of Artificial Sequence: Synthetic peptide
NNNNEE

SEQ ID NO: 622 - protein, 6 aa, Artificial Sequence
  Description of Artificial Sequence: Synthetic peptide
EENNNN

SEQ ID NO: 623 - protein, 6 aa, Artificial Sequence
  Description of Artificial Sequence: Synthetic peptide
ENENNN

SEQ ID NO: 624 - protein, 6 aa, Artificial Sequence
  Description of Artificial Sequence: Synthetic peptide
ENNENN

SEQ ID NO: 625 - protein, 6 aa, Artificial Sequence
  Description of Artificial Sequence: Synthetic peptide
ENNNEN

SEQ ID NO: 626 - protein, 6 aa, Artificial Sequence
  Description of Artificial Sequence: Synthetic peptide
ENNNNE

SEQ ID NO: 627 - protein, 6 aa, Artificial Sequence
  Description of Artificial Sequence: Synthetic peptide
NEENNN

SEQ ID NO: 628 - protein, 6 aa, Artificial Sequence
  Description of Artificial Sequence: Synthetic peptide
NENENN

SEQ ID NO: 629 - protein, 6 aa, Artificial Sequence
  Description of Artificial Sequence: Synthetic peptide
NENNEN

SEQ ID NO: 630 - protein, 6 aa, Artificial Sequence
  Description of Artificial Sequence: Synthetic peptide
NENNNE

SEQ ID NO: 631 - protein, 6 aa, Artificial Sequence
  Description of Artificial Sequence: Synthetic peptide
NNEENN

SEQ ID NO: 632 - protein, 6 aa, Artificial Sequence
  Description of Artificial Sequence: Synthetic peptide
NNENEN

SEQ ID NO: 633 - protein, 6 aa, Artificial Sequence
  Description of Artificial Sequence: Synthetic peptide
NNENNE

SEQ ID NO: 634 - protein, 6 aa, Artificial Sequence
  Description of Artificial Sequence: Synthetic peptide
NNNEEN

SEQ ID NO: 635 - protein, 6 aa, Artificial Sequence
  Description of Artificial Sequence: Synthetic peptide
NNNENE

SEQ ID NO: 636 - protein, 7 aa, Artificial Sequence
  Description of Artificial Sequence: Synthetic peptide
NNNNEEE

SEQ ID NO: 637 - protein, 7 aa, Artificial Sequence
  Description of Artificial Sequence: Synthetic peptide
EEENNNN

SEQ ID NO: 638 - protein, 7 aa, Artificial Sequence
  Description of Artificial Sequence: Synthetic peptide
ENEENNN

SEQ ID NO: 639 - protein, 7 aa, Artificial Sequence
  Description of Artificial Sequence: Synthetic peptide
ENENENN

SEQ ID NO: 640 - protein, 7 aa, Artificial Sequence
  Description of Artificial Sequence: Synthetic peptide
ENENNEN

SEQ ID NO: 641 - protein, 7 aa, Artificial Sequence
  Description of Artificial Sequence: Synthetic peptide
ENENNNE

SEQ ID NO: 642 - protein, 7 aa, Artificial Sequence
  Description of Artificial Sequence: Synthetic peptide
ENNEENN

SEQ ID NO: 643 - protein, 7 aa, Artificial Sequence
  Description of Artificial Sequence: Synthetic peptide
ENNENEN

SEQ ID NO: 644 - protein, 7 aa, Artificial Sequence
  Description of Artificial Sequence: Synthetic peptide
ENNENNE

SEQ ID NO: 645 - protein, 7 aa, Artificial Sequence
  Description of Artificial Sequence: Synthetic peptide
ENNNENE

SEQ ID NO: 646 - protein, 7 aa, Artificial Sequence
  Description of Artificial Sequence: Synthetic peptide
ENNNEEN

SEQ ID NO: 647 - protein, 7 aa, Artificial Sequence
  Description of Artificial Sequence: Synthetic peptide
ENNNNEE

SEQ ID NO: 648 - protein, 7 aa, Artificial Sequence
  Description of Artificial Sequence: Synthetic peptide
EENENNN

SEQ ID NO: 649 - protein, 7 aa, Artificial Sequence
  Description of Artificial Sequence: Synthetic peptide
EENNENN

SEQ ID NO: 650 - protein, 7 aa, Artificial Sequence
  Description of Artificial Sequence: Synthetic peptide
EENNNEN

SEQ ID NO: 651 - protein, 7 aa, Artificial Sequence
  Description of Artificial Sequence: Synthetic peptide
EENNNNE

SEQ ID NO: 652 - protein, 7 aa, Artificial Sequence
  Description of Artificial Sequence: Synthetic peptide
NEEENNN

SEQ ID NO: 653 - protein, 7 aa, Artificial Sequence
  Description of Artificial Sequence: Synthetic peptide
NEENENN

SEQ ID NO: 654 - protein, 7 aa, Artificial Sequence
  Description of Artificial Sequence: Synthetic peptide
NEENNEN

SEQ ID NO: 655 - protein, 7 aa, Artificial Sequence
  Description of Artificial Sequence: Synthetic peptide
NEENNNE

SEQ ID NO: 656 - protein, 7 aa, Artificial Sequence
  Description of Artificial Sequence: Synthetic peptide
NENEENN

SEQ ID NO: 657 - protein, 7 aa, Artificial Sequence
  Description of Artificial Sequence: Synthetic peptide
NENNEEN

SEQ ID NO: 658 - protein, 7 aa, Artificial Sequence
  Description of Artificial Sequence: Synthetic peptide
NENNNEE

SEQ ID NO: 659 - protein, 7 aa, Artificial Sequence
  Description of Artificial Sequence: Synthetic peptide
NENENEN

SEQ ID NO: 660 - protein, 7 aa, Artificial Sequence
  Description of Artificial Sequence: Synthetic peptide
NENENNE

SEQ ID NO: 661 - protein, 7 aa, Artificial Sequence
  Description of Artificial Sequence: Synthetic peptide
NENNENE

SEQ ID NO: 662 - protein, 7 aa, Artificial Sequence
  Description of Artificial Sequence: Synthetic peptide
NNEEENN

SEQ ID NO: 663 - protein, 7 aa, Artificial Sequence
  Description of Artificial Sequence: Synthetic peptide
NNEENEN

SEQ ID NO: 664 - protein, 7 aa, Artificial Sequence
  Description of Artificial Sequence: Synthetic peptide
NNEENNE

SEQ ID NO: 665 - protein, 7 aa, Artificial Sequence
  Description of Artificial Sequence: Synthetic peptide
NNENEEN

SEQ ID NO: 666 - protein, 7 aa, Artificial Sequence
  Description of Artificial Sequence: Synthetic peptide
NNENENE

SEQ ID NO: 667 - protein, 7 aa, Artificial Sequence
  Description of Artificial Sequence: Synthetic peptide
NNENNEE

SEQ ID NO: 668 - protein, 7 aa, Artificial Sequence
  Description of Artificial Sequence: Synthetic peptide
NNNEEEN

SEQ ID NO: 669 - protein, 7 aa, Artificial Sequence
  Description of Artificial Sequence: Synthetic peptide
NNNEENE

SEQ ID NO: 670 - protein, 7 aa, Artificial Sequence
  Description of Artificial Sequence: Synthetic peptide
NNNENEE

SEQ ID NO: 671 - protein, 7 aa, Artificial Sequence
  Description of Artificial Sequence: Synthetic peptide
NNNNNEE

SEQ ID NO: 672 - protein, 7 aa, Artificial Sequence
  Description of Artificial Sequence: Synthetic peptide
EENNNNN

SEQ ID NO: 673 - protein, 7 aa, Artificial Sequence
  Description of Artificial Sequence: Synthetic peptide
ENENNNN

SEQ ID NO: 674 - protein, 7 aa, Artificial Sequence
  Description of Artificial Sequence: Synthetic peptide
ENNENNN

SEQ ID NO: 675 - protein, 7 aa, Artificial Sequence
  Description of Artificial Sequence: Synthetic peptide
ENNNENN

SEQ ID NO: 676 - protein, 7 aa, Artificial Sequence
  Description of Artificial Sequence: Synthetic peptide
ENNNNEN

SEQ ID NO: 677 - protein, 7 aa, Artificial Sequence
  Description of Artificial Sequence: Synthetic peptide
ENNNNNE

SEQ ID NO: 678 - protein, 7 aa, Artificial Sequence
  Description of Artificial Sequence: Synthetic peptide
NEENNNN

SEQ ID NO: 679 - protein, 7 aa, Artificial Sequence
  Description of Artificial Sequence: Synthetic peptide
NENENNN

SEQ ID NO: 680 - protein, 7 aa, Artificial Sequence
  Description of Artificial Sequence: Synthetic peptide
NENNENN

SEQ ID NO: 681 - protein, 7 aa, Artificial Sequence
  Description of Artificial Sequence: Synthetic peptide
NENNNEN

SEQ ID NO: 682 - protein, 7 aa, Artificial Sequence
  Description of Artificial Sequence: Synthetic peptide
NENNNNE

SEQ ID NO: 683 - protein, 7 aa, Artificial Sequence
  Description of Artificial Sequence: Synthetic peptide
NNEENNN

SEQ ID NO: 684 - protein, 7 aa, Artificial Sequence
  Description of Artificial Sequence: Synthetic peptide
NNENENN

SEQ ID NO: 685 - protein, 7 aa, Artificial Sequence
  Description of Artificial Sequence: Synthetic peptide
NNENNEN

SEQ ID NO: 686 - protein, 7 aa, Artificial Sequence
  Description of Artificial Sequence: Synthetic peptide
NNENNNE

SEQ ID NO: 687 - protein, 7 aa, Artificial Sequence
  Description of Artificial Sequence: Synthetic peptide
NNNEENN

SEQ ID NO: 688 - protein, 7 aa, Artificial Sequence
  Description of Artificial Sequence: Synthetic peptide
NNNENEN

SEQ ID NO: 689 - protein, 7 aa, Artificial Sequence
  Description of Artificial Sequence: Synthetic peptide
NNNENNE

SEQ ID NO: 690 - protein, 7 aa, Artificial Sequence
  Description of Artificial Sequence: Synthetic peptide
NNNNEEN

SEQ ID NO: 691 - protein, 7 aa, Artificial Sequence
  Description of Artificial Sequence: Synthetic peptide
NNNNENE

SEQ ID NO: 692 - protein, 7 aa, Artificial Sequence
  Description of Artificial Sequence: Synthetic peptide
NNNNNNE

SEQ ID NO: 693 - protein, 7 aa, Artificial Sequence
  Description of Artificial Sequence: Synthetic peptide
ENNNNNN

SEQ ID NO: 694 - protein, 7 aa, Artificial Sequence
  Description of Artificial Sequence: Synthetic peptide
NENNNNN

SEQ ID NO: 695 - protein, 7 aa, Artificial Sequence
  Description of Artificial Sequence: Synthetic peptide
NNENNNN

SEQ ID NO: 696 - protein, 7 aa, Artificial Sequence
  Description of Artificial Sequence: Synthetic peptide
NNNENNN

SEQ ID NO: 697 - protein, 7 aa, Artificial Sequence
  Description of Artificial Sequence: Synthetic peptide
NNNNENN

SEQ ID NO: 698 - protein, 7 aa, Artificial Sequence
  Description of Artificial Sequence: Synthetic peptide
NNNNNEN

SEQ ID NO: 699 - protein, 4 aa, Artificial Sequence
  Description of Artificial Sequence: Synthetic peptide
NNNH

SEQ ID NO: 700 - protein, 4 aa, Artificial Sequence
  Description of Artificial Sequence: Synthetic peptide
HNNN

SEQ ID NO: 701 - protein, 4 aa, Artificial Sequence
  Description of Artificial Sequence: Synthetic peptide
NHNN

SEQ ID NO: 702 - protein, 4 aa, Artificial Sequence
  Description of Artificial Sequence: Synthetic peptide
NNHN

SEQ ID NO: 703 - protein, 5 aa, Artificial Sequence
  Description of Artificial Sequence: Synthetic peptide
NNNNH

SEQ ID NO: 704 - protein, 5 aa, Artificial Sequence
  Description of Artificial Sequence: Synthetic peptide
HNNNN

SEQ ID NO: 705 - protein, 5 aa, Artificial Sequence
  Description of Artificial Sequence: Synthetic peptide
NHNNN

SEQ ID NO: 706 - protein, 5 aa, Artificial Sequence
  Description of Artificial Sequence: Synthetic peptide
NNHNN

SEQ ID NO: 707 - protein, 5 aa, Artificial Sequence
  Description of Artificial Sequence: Synthetic peptide
NNNHN

SEQ ID NO: 708 - protein, 5 aa, Artificial Sequence
  Description of Artificial Sequence: Synthetic peptide
NNNHH

SEQ ID NO: 709 - protein, 5 aa, Artificial Sequence
  Description of Artificial Sequence: Synthetic peptide
HHNNN

SEQ ID NO: 710 - protein, 5 aa, Artificial Sequence
  Description of Artificial Sequence: Synthetic peptide
HNHNN

SEQ ID NO: 711 - protein, 5 aa, Artificial Sequence
  Description of Artificial Sequence: Synthetic peptide
HNNHN

SEQ ID NO: 712 - protein, 5 aa, Artificial Sequence
  Description of Artificial Sequence: Synthetic peptide
HNNNH

SEQ ID NO: 713 - protein, 5 aa, Artificial Sequence
  Description of Artificial Sequence: Synthetic peptide
NHHNN

SEQ ID NO: 714 - protein, 5 aa, Artificial Sequence
  Description of Artificial Sequence: Synthetic peptide
NHNHN

SEQ ID NO: 715 - protein, 5 aa, Artificial Sequence
  Description of Artificial Sequence: Synthetic peptide
NHNNH

SEQ ID NO: 716 - protein, 5 aa, Artificial Sequence
  Description of Artificial Sequence: Synthetic peptide
NNHHN

SEQ ID NO: 717 - protein, 5 aa, Artificial Sequence
  Description of Artificial Sequence: Synthetic peptide
NNHNH

SEQ ID NO: 718 - protein, 6 aa, Artificial Sequence
  Description of Artificial Sequence: Synthetic peptide
NNNNNH

SEQ ID NO: 719 - protein, 6 aa, Artificial Sequence
  Description of Artificial Sequence: Synthetic peptide
HNNNNN

SEQ ID NO: 720 - protein, 6 aa, Artificial Sequence
  Description of Artificial Sequence: Synthetic peptide
NHNNNN

SEQ ID NO: 721 - protein, 6 aa, Artificial Sequence
  Description of Artificial Sequence: Synthetic peptide
NNHNNN

SEQ ID NO: 722 - protein, 6 aa, Artificial Sequence
  Description of Artificial Sequence: Synthetic peptide
NNNHNN

SEQ ID NO: 723 - protein, 6 aa, Artificial Sequence
  Description of Artificial Sequence: Synthetic peptide
NNNNHN

SEQ ID NO: 724 - protein, 6 aa, Artificial Sequence
  Description of Artificial Sequence: Synthetic peptide
NNNNHH

SEQ ID NO: 725 - protein, 6 aa, Artificial Sequence
  Description of Artificial Sequence: Synthetic peptide
HHNNNN

SEQ ID NO: 726 - protein, 6 aa, Artificial Sequence
  Description of Artificial Sequence: Synthetic peptide
HNHNNN

SEQ ID NO: 727 - protein, 6 aa, Artificial Sequence
  Description of Artificial Sequence: Synthetic peptide
HNNHNN

SEQ ID NO: 728 - protein, 6 aa, Artificial Sequence
  Description of Artificial Sequence: Synthetic peptide
HNNNHN

SEQ ID NO: 729 - protein, 6 aa, Artificial Sequence
  Description of Artificial Sequence: Synthetic peptide
HNNNNH

SEQ ID NO: 730 - protein, 6 aa, Artificial Sequence
  Description of Artificial Sequence: Synthetic peptide
NHHNNN

SEQ ID NO: 731 - protein, 6 aa, Artificial Sequence
  Description of Artificial Sequence: Synthetic peptide
NHNHNN

SEQ ID NO: 732 - protein, 6 aa, Artificial Sequence
  Description of Artificial Sequence: Synthetic peptide
NHNNHN

SEQ ID NO: 733 - protein, 6 aa, Artificial Sequence
  Description of Artificial Sequence: Synthetic peptide
NHNNNH

SEQ ID NO: 734 - protein, 6 aa, Artificial Sequence
  Description of Artificial Sequence: Synthetic peptide
NNHHNN

SEQ ID NO: 735 - protein, 6 aa, Artificial Sequence
  Description of Artificial Sequence: Synthetic peptide
NNHNHN

SEQ ID NO: 736 - protein, 6 aa, Artificial Sequence
  Description of Artificial Sequence: Synthetic peptide
NNHNNH

SEQ ID NO: 737 - protein, 6 aa, Artificial Sequence
  Description of Artificial Sequence: Synthetic peptide
NNNHHN

SEQ ID NO: 738 - protein, 6 aa, Artificial Sequence
  Description of Artificial Sequence: Synthetic peptide
NNNHNH

SEQ ID NO: 739 - protein, 7 aa, Artificial Sequence
  Description of Artificial Sequence: Synthetic peptide
NNNNHHH

SEQ ID NO: 740 - protein, 7 aa, Artificial Sequence
  Description of Artificial Sequence: Synthetic peptide
HHHNNNN

SEQ ID NO: 741 - protein, 7 aa, Artificial Sequence
  Description of Artificial Sequence: Synthetic peptide
HNHHNNN

SEQ ID NO: 742 - protein, 7 aa, Artificial Sequence
  Description of Artificial Sequence: Synthetic peptide
HNHNHNN

SEQ ID NO: 743 - protein, 7 aa, Artificial Sequence
  Description of Artificial Sequence: Synthetic peptide
HNHNNHN

SEQ ID NO: 744 - protein, 7 aa, Artificial Sequence
  Description of Artificial Sequence: Synthetic peptide
HNHNNNH

SEQ ID NO: 745 - protein, 7 aa, Artificial Sequence
  Description of Artificial Sequence: Synthetic peptide
HNNHHNN

SEQ ID NO: 746 - protein, 7 aa, Artificial Sequence
  Description of Artificial Sequence: Synthetic peptide
HNNHNHN

SEQ ID NO: 747 - protein, 7 aa, Artificial Sequence
  Description of Artificial Sequence: Synthetic peptide
HNNHNNH

SEQ ID NO: 748 - protein, 7 aa, Artificial Sequence
  Description of Artificial Sequence: Synthetic peptide
HNNNHNH

SEQ ID NO: 749 - protein, 7 aa, Artificial Sequence
  Description of Artificial Sequence: Synthetic peptide
HNNNHHN

SEQ ID NO: 750 - protein, 7 aa, Artificial Sequence
  Description of Artificial Sequence: Synthetic peptide
HNNNNHH

SEQ ID NO: 751 - protein, 7 aa, Artificial Sequence
  Description of Artificial Sequence: Synthetic peptide
HHNHNNN

SEQ ID NO: 752 - protein, 7 aa, Artificial Sequence
  Description of Artificial Sequence: Synthetic peptide
HHNNHNN

SEQ ID NO: 753 - protein, 7 aa, Artificial Sequence
  Description of Artificial Sequence: Synthetic peptide
HHNNNHN

SEQ ID NO: 754 - protein, 7 aa, Artificial Sequence
  Description of Artificial Sequence: Synthetic peptide
HHNNNNH

SEQ ID NO: 755 - protein, 7 aa, Artificial Sequence
  Description of Artificial Sequence: Synthetic peptide
NHHHNNN

SEQ ID NO: 756 - protein, 7 aa, Artificial Sequence
  Description of Artificial Sequence: Synthetic peptide
NHHNHNN

SEQ ID NO: 757 - protein, 7 aa, Artificial Sequence
  Description of Artificial Sequence: Synthetic peptide
NHHNNHN

SEQ ID NO: 758 - protein, 7 aa, Artificial Sequence
  Description of Artificial Sequence: Synthetic peptide
NHHNNNH

SEQ ID NO: 759 - protein, 7 aa, Artificial Sequence
  Description of Artificial Sequence: Synthetic peptide
NHNHHNN

SEQ ID NO: 760 - protein, 7 aa, Artificial Sequence
  Description of Artificial Sequence: Synthetic peptide
NHNNHHN

SEQ ID NO: 761 - protein, 7 aa, Artificial Sequence
  Description of Artificial Sequence: Synthetic peptide
NHNNNHH

SEQ ID NO: 762 - protein, 7 aa, Artificial Sequence
  Description of Artificial Sequence: Synthetic peptide
NHNHNHN

SEQ ID NO: 763 - protein, 7 aa, Artificial Sequence
  Description of Artificial Sequence: Synthetic peptide
NHNHNNH

SEQ ID NO: 764 - protein, 7 aa, Artificial Sequence
  Description of Artificial Sequence: Synthetic peptide
NHNNHNH

SEQ ID NO: 765 - protein, 7 aa, Artificial Sequence
  Description of Artificial Sequence: Synthetic peptide
NNHHHNN

SEQ ID NO: 766 - protein, 7 aa, Artificial Sequence
  Description of Artificial Sequence: Synthetic peptide
NNHHNHN

SEQ ID NO: 767 - protein, 7 aa, Artificial Sequence
  Description of Artificial Sequence: Synthetic peptide
NNHHNNH

SEQ ID NO: 768 - protein, 7 aa, Artificial Sequence
  Description of Artificial Sequence: Synthetic peptide
NNHNHHN

SEQ ID NO: 769 - protein, 7 aa, Artificial Sequence
  Description of Artificial Sequence: Synthetic peptide
NNHNHNH

SEQ ID NO: 770 - protein, 7 aa, Artificial Sequence
  Description of Artificial Sequence: Synthetic peptide
NNHNNHH

SEQ ID NO: 771 - protein, 7 aa, Artificial Sequence
  Description of Artificial Sequence: Synthetic peptide
NNNHHHN

SEQ ID NO: 772 - protein, 7 aa, Artificial Sequence
  Description of Artificial Sequence: Synthetic peptide
NNNHHNH

SEQ ID NO: 773 - protein, 7 aa, Artificial Sequence
  Description of Artificial Sequence: Synthetic peptide
NNNHNHH

SEQ ID NO: 774 - protein, 7 aa, Artificial Sequence
  Description of Artificial Sequence: Synthetic peptide
NNNNNHH

SEQ ID NO: 775 - protein, 7 aa, Artificial Sequence
  Description of Artificial Sequence: Synthetic peptide
HHNNNNN

SEQ ID NO: 776 - protein, 7 aa, Artificial Sequence
  Description of Artificial Sequence: Synthetic peptide
HNHNNNN

SEQ ID NO: 777 - protein, 7 aa, Artificial Sequence
  Description of Artificial Sequence: Synthetic peptide
HNNHNNN

SEQ ID NO: 778 - protein, 7 aa, Artificial Sequence
  Description of Artificial Sequence: Synthetic peptide
HNNNHNN

SEQ ID NO: 779 - protein, 7 aa, Artificial Sequence
  Description of Artificial Sequence: Synthetic peptide
HNNNNHN

SEQ ID NO: 780 - protein, 7 aa, Artificial Sequence
  Description of Artificial Sequence: Synthetic peptide
HNNNNNH

SEQ ID NO: 781 - protein, 7 aa, Artificial Sequence
  Description of Artificial Sequence: Synthetic peptide
NHHNNNN

SEQ ID NO: 782 - protein, 7 aa, Artificial Sequence
  Description of Artificial Sequence: Synthetic peptide
NHNHNNN

SEQ ID NO: 783 - protein, 7 aa, Artificial Sequence
  Description of Artificial Sequence: Synthetic peptide
NHNNHNN

SEQ ID NO: 784 - protein, 7 aa, Artificial Sequence
  Description of Artificial Sequence: Synthetic peptide
NHNNNHN

SEQ ID NO: 785 - protein, 7 aa, Artificial Sequence
  Description of Artificial Sequence: Synthetic peptide
NHNNNNH

SEQ ID NO: 786 - protein, 7 aa, Artificial Sequence
  Description of Artificial Sequence: Synthetic peptide
NNHHNNN

SEQ ID NO: 787 - protein, 7 aa, Artificial Sequence
  Description of Artificial Sequence: Synthetic peptide
NNHNHNN

SEQ ID NO: 788 - protein, 7 aa, Artificial Sequence
  Description of Artificial Sequence: Synthetic peptide
NNHNNHN

SEQ ID NO: 789 - protein, 7 aa, Artificial Sequence
  Description of Artificial Sequence: Synthetic peptide
NNHNNNH

SEQ ID NO: 790 - protein, 7 aa, Artificial Sequence
  Description of Artificial Sequence: Synthetic peptide
NNNHHNN

SEQ ID NO: 791 - protein, 7 aa, Artificial Sequence
  Description of Artificial Sequence: Synthetic peptide
NNNHNHN

SEQ ID NO: 792 - protein, 7 aa, Artificial Sequence
  Description of Artificial Sequence: Synthetic peptide
NNNHNNH

SEQ ID NO: 793 - protein, 7 aa, Artificial Sequence
  Description of Artificial Sequence: Synthetic peptide
NNNNHHN

SEQ ID NO: 794 - protein, 7 aa, Artificial Sequence
  Description of Artificial Sequence: Synthetic peptide
NNNNHNH

SEQ ID NO: 795 - protein, 7 aa, Artificial Sequence
  Description of Artificial Sequence: Synthetic peptide
NNNNNNH

SEQ ID NO: 796 - protein, 7 aa, Artificial Sequence
  Description of Artificial Sequence: Synthetic peptide
HNNNNNN

SEQ ID NO: 797 - protein, 7 aa, Artificial Sequence
  Description of Artificial Sequence: Synthetic peptide
NHNNNNN

SEQ ID NO: 798 - protein, 7 aa, Artificial Sequence
  Description of Artificial Sequence: Synthetic peptide
NNHNNNN

SEQ ID NO: 799 - protein, 7 aa, Artificial Sequence
  Description of Artificial Sequence: Synthetic peptide
NNNHNNN

SEQ ID NO: 800 - protein, 7 aa, Artificial Sequence
  Description of Artificial Sequence: Synthetic peptide
NNNNHNN

SEQ ID NO: 801 - protein, 7 aa, Artificial Sequence
  Description of Artificial Sequence: Synthetic peptide
NNNNNHN

SEQ ID NO: 802 - protein, 4 aa, Artificial Sequence
  Description of Artificial Sequence: Synthetic peptide
NNND

SEQ ID NO: 803 - protein, 4 aa, Artificial Sequence
  Description of Artificial Sequence: Synthetic peptide
DNNN

SEQ ID NO: 804 - protein, 4 aa, Artificial Sequence
  Description of Artificial Sequence: Synthetic peptide
NDNN

SEQ ID NO: 805 - protein, 4 aa, Artificial Sequence
  Description of Artificial Sequence: Synthetic peptide
NNDN

SEQ ID NO: 806 - protein, 5 aa, Artificial Sequence
  Description of Artificial Sequence: Synthetic peptide
NNNND

SEQ ID NO: 807 - protein, 5 aa, Artificial Sequence
  Description of Artificial Sequence: Synthetic peptide
DNNNN

SEQ ID NO: 808 - protein, 5 aa, Artificial Sequence
  Description of Artificial Sequence: Synthetic peptide
NDNNN

SEQ ID NO: 809 - protein, 5 aa, Artificial Sequence
  Description of Artificial Sequence: Synthetic peptide
NNDNN

SEQ ID NO: 810 - protein, 5 aa, Artificial Sequence
  Description of Artificial Sequence: Synthetic peptide
NNNDN

SEQ ID NO: 811 - protein, 5 aa, Artificial Sequence
  Description of Artificial Sequence: Synthetic peptide
NNNDD

SEQ ID NO: 812 - protein, 5 aa, Artificial Sequence
  Description of Artificial Sequence: Synthetic peptide
DDNNN

SEQ ID NO: 813 - protein, 5 aa, Artificial Sequence
  Description of Artificial Sequence: Synthetic peptide
DNDNN

SEQ ID NO: 814 - protein, 5 aa, Artificial Sequence
  Description of Artificial Sequence: Synthetic peptide
DNNDN

SEQ ID NO: 815 - protein, 5 aa, Artificial Sequence
  Description of Artificial Sequence: Synthetic peptide
DNNND

SEQ ID NO: 816 - protein, 5 aa, Artificial Sequence
  Description of Artificial Sequence: Synthetic peptide
NDDNN

SEQ ID NO: 817 - protein, 5 aa, Artificial Sequence
  Description of Artificial Sequence: Synthetic peptide
NDNDN

SEQ ID NO: 818 - protein, 5 aa, Artificial Sequence
  Description of Artificial Sequence: Synthetic peptide
NDNND

SEQ ID NO: 819 - protein, 5 aa, Artificial Sequence
  Description of Artificial Sequence: Synthetic peptide
NNDDN

SEQ ID NO: 820 - protein, 5 aa, Artificial Sequence
  Description of Artificial Sequence: Synthetic peptide
NNDND

SEQ ID NO: 821 - protein, 6 aa, Artificial Sequence
  Description of Artificial Sequence: Synthetic peptide
NNNNND

SEQ ID NO: 822 - protein, 6 aa, Artificial Sequence
  Description of Artificial Sequence: Synthetic peptide
DNNNNN

SEQ ID NO: 823 - protein, 6 aa, Artificial Sequence
  Description of Artificial Sequence: Synthetic peptide
NDNNNN

SEQ ID NO: 824 - protein, 6 aa, Artificial Sequence
  Description of Artificial Sequence: Synthetic peptide
NNDNNN

SEQ ID NO: 825 - protein, 6 aa, Artificial Sequence
  Description of Artificial Sequence: Synthetic peptide
NNNDNN

SEQ ID NO: 826 - protein, 6 aa, Artificial Sequence
  Description of Artificial Sequence: Synthetic peptide
NNNNDN

SEQ ID NO: 827 - protein, 6 aa, Artificial Sequence
  Description of Artificial Sequence: Synthetic peptide
NNNNDD

SEQ ID NO: 828 - protein, 6 aa, Artificial Sequence
  Description of Artificial Sequence: Synthetic peptide
DDNNNN

SEQ ID NO: 829 - protein, 6 aa, Artificial Sequence
  Description of Artificial Sequence: Synthetic peptide
DNDNNN

SEQ ID NO: 830 - protein, 6 aa, Artificial Sequence
  Description of Artificial Sequence: Synthetic peptide
DNNDNN

SEQ ID NO: 831 - protein, 6 aa, Artificial Sequence
  Description of Artificial Sequence: Synthetic peptide
DNNNDN

SEQ ID NO: 832 - protein, 6 aa, Artificial Sequence
  Description of Artificial Sequence: Synthetic peptide
DNNNND

SEQ ID NO: 833 - protein, 6 aa, Artificial Sequence
  Description of Artificial Sequence: Synthetic peptide
NDDNNN

SEQ ID NO: 834 - protein, 6 aa, Artificial Sequence
  Description of Artificial Sequence: Synthetic peptide
NDNDNN

SEQ ID NO: 835 - protein, 6 aa, Artificial Sequence
  Description of Artificial Sequence: Synthetic peptide
NDNNDN

SEQ ID NO: 836 - protein, 6 aa, Artificial Sequence
  Description of Artificial Sequence: Synthetic peptide
NDNNND

SEQ ID NO: 837 - protein, 6 aa, Artificial Sequence
  Description of Artificial Sequence: Synthetic peptide
NNDDNN

SEQ ID NO: 838 - protein, 6 aa, Artificial Sequence
  Description of Artificial Sequence: Synthetic peptide
NNDNDN

SEQ ID NO: 839 - protein, 6 aa, Artificial Sequence
  Description of Artificial Sequence: Synthetic peptide
NNDNND

SEQ ID NO: 840 - protein, 6 aa, Artificial Sequence
  Description of Artificial Sequence: Synthetic peptide
NNNDDN

SEQ ID NO: 841 - protein, 6 aa, Artificial Sequence
  Description of Artificial Sequence: Synthetic peptide
NNNDND

SEQ ID NO: 842 - protein, 7 aa, Artificial Sequence
  Description of Artificial Sequence: Synthetic peptide
NNNNDDD

SEQ ID NO: 843 - protein, 7 aa, Artificial Sequence
  Description of Artificial Sequence: Synthetic peptide
DDDNNNN

SEQ ID NO: 844 - protein, 7 aa, Artificial Sequence
  Description of Artificial Sequence: Synthetic peptide
DNDDNNN

SEQ ID NO: 845 - protein, 7 aa, Artificial Sequence
  Description of Artificial Sequence: Synthetic peptide
DNDNDNN

SEQ ID NO: 846 - protein, 7 aa, Artificial Sequence
  Description of Artificial Sequence: Synthetic peptide
DNDNNDN

SEQ ID NO: 847 - protein, 7 aa, Artificial Sequence
  Description of Artificial Sequence: Synthetic peptide
DNDNNND

SEQ ID NO: 848 - protein, 7 aa, Artificial Sequence
  Description of Artificial Sequence: Synthetic peptide
DNNDDNN

SEQ ID NO: 849 - protein, 7 aa, Artificial Sequence
  Description of Artificial Sequence: Synthetic peptide
DNNDNDN

SEQ ID NO: 850 - protein, 7 aa, Artificial Sequence
  Description of Artificial Sequence: Synthetic peptide
DNNDNND

SEQ ID NO: 851 - protein, 7 aa, Artificial Sequence
  Description of Artificial Sequence: Synthetic peptide
DNNNDND

SEQ ID NO: 852 - protein, 7 aa, Artificial Sequence
  Description of Artificial Sequence: Synthetic peptide
DNNNDDN

SEQ ID NO: 853 - protein, 7 aa, Artificial Sequence
  Description of Artificial Sequence: Synthetic peptide
DNNNNDD

SEQ ID NO: 854 - protein, 7 aa, Artificial Sequence
  Description of Artificial Sequence: Synthetic peptide
DDNDNNN

SEQ ID NO: 855 - protein, 7 aa, Artificial Sequence
  Description of Artificial Sequence: Synthetic peptide
DDNNDNN

SEQ ID NO: 856 - protein, 7 aa, Artificial Sequence
  Description of Artificial Sequence: Synthetic peptide
DDNNNDN

SEQ ID NO: 857 - protein, 7 aa, Artificial Sequence
  Description of Artificial Sequence: Synthetic peptide
DDNNNND

SEQ ID NO: 858 - protein, 7 aa, Artificial Sequence
  Description of Artificial Sequence: Synthetic peptide
NDDDNNN

SEQ ID NO: 859 - protein, 7 aa, Artificial Sequence
  Description of Artificial Sequence: Synthetic peptide
NDDNDNN

SEQ ID NO: 860 - protein, 7 aa, Artificial Sequence
  Description of Artificial Sequence: Synthetic peptide
NDDNNDN

SEQ ID NO: 861 - protein, 7 aa, Artificial Sequence
  Description of Artificial Sequence: Synthetic peptide
NDDNNND

SEQ ID NO: 862 - protein, 7 aa, Artificial Sequence
  Description of Artificial Sequence: Synthetic peptide
NDNDDNN

SEQ ID NO: 863 - protein, 7 aa, Artificial Sequence
  Description of Artificial Sequence: Synthetic peptide
NDNNDDN

SEQ ID NO: 864 - protein, 7 aa, Artificial Sequence
  Description of Artificial Sequence: Synthetic peptide
NDNNNDD

SEQ ID NO: 865 - protein, 7 aa, Artificial Sequence
  Description of Artificial Sequence: Synthetic peptide
NDNDNDN

SEQ ID NO: 866 - protein, 7 aa, Artificial Sequence
  Description of Artificial Sequence: Synthetic peptide
NDNDNND

SEQ ID NO: 867 - protein, 7 aa, Artificial Sequence
  Description of Artificial Sequence: Synthetic peptide
NDNNDND

SEQ ID NO: 868 - protein, 7 aa, Artificial Sequence
  Description of Artificial Sequence: Synthetic peptide
NNDDDNN

SEQ ID NO: 869 - protein, 7 aa, Artificial Sequence
  Description of Artificial Sequence: Synthetic peptide
NNDDNDN

SEQ ID NO: 870 - protein, 7 aa, Artificial Sequence
  Description of Artificial Sequence: Synthetic peptide
NNDDNND

SEQ ID NO: 871 - protein, 7 aa, Artificial Sequence
  Description of Artificial Sequence: Synthetic peptide
NNDNDDN

SEQ ID NO: 872 - protein, 7 aa, Artificial Sequence
  Description of Artificial Sequence: Synthetic peptide
NNDNDND

SEQ ID NO: 873 - protein, 7 aa, Artificial Sequence
  Description of Artificial Sequence: Synthetic peptide
NNDNNDD

SEQ ID NO: 874 - protein, 7 aa, Artificial Sequence
  Description of Artificial Sequence: Synthetic peptide
NNNDDDN

SEQ ID NO: 875 - protein, 7 aa, Artificial Sequence
  Description of Artificial Sequence: Synthetic peptide
NNNDDND

SEQ ID NO: 876 - protein, 7 aa, Artificial Sequence
  Description of Artificial Sequence: Synthetic peptide
NNNDNDD

SEQ ID NO: 877 - protein, 7 aa, Artificial Sequence
  Description of Artificial Sequence: Synthetic peptide
NNNNNDD

SEQ ID NO: 878 - protein, 7 aa, Artificial Sequence
  Description of Artificial Sequence: Synthetic peptide
DDNNNNN

SEQ ID NO: 879 - protein, 7 aa, Artificial Sequence
  Description of Artificial Sequence: Synthetic peptide
DNDNNNN

SEQ ID NO: 880 - protein, 7 aa, Artificial Sequence
  Description of Artificial Sequence: Synthetic peptide
DNNDNNN

SEQ ID NO: 881 - protein, 7 aa, Artificial Sequence
  Description of Artificial Sequence: Synthetic peptide
DNNNDNN

SEQ ID NO: 882 - protein, 7 aa, Artificial Sequence
  Description of Artificial Sequence: Synthetic peptide
DNNNNDN

SEQ ID NO: 883 - protein, 7 aa, Artificial Sequence
  Description of Artificial Sequence: Synthetic peptide
DNNNNND

SEQ ID NO: 884 - protein, 7 aa, Artificial Sequence
  Description of Artificial Sequence: Synthetic peptide
NDDNNNN

SEQ ID NO: 885 - protein, 7 aa, Artificial Sequence
  Description of Artificial Sequence: Synthetic peptide
NDNDNNN

SEQ ID NO: 886 - protein, 7 aa, Artificial Sequence
  Description of Artificial Sequence: Synthetic peptide
NDNNDNN

SEQ ID NO: 887 - protein, 7 aa, Artificial Sequence
  Description of Artificial Sequence: Synthetic peptide
NDNNNDN

SEQ ID NO: 888 - protein, 7 aa, Artificial Sequence
  Description of Artificial Sequence: Synthetic peptide
NDNNNND

SEQ ID NO: 889 - protein, 7 aa, Artificial Sequence
  Description of Artificial Sequence: Synthetic peptide
NNDDNNN

SEQ ID NO: 890 - protein, 7 aa, Artificial Sequence
  Description of Artificial Sequence: Synthetic peptide
NNDNDNN

SEQ ID NO: 891 - protein, 7 aa, Artificial Sequence
  Description of Artificial Sequence: Synthetic peptide
NNDNNDN

SEQ ID NO: 892 - protein, 7 aa, Artificial Sequence
  Description of Artificial Sequence: Synthetic peptide
NNDNNND

SEQ ID NO: 893 - protein, 7 aa, Artificial Sequence
  Description of Artificial Sequence: Synthetic peptide
NNNDDNN

SEQ ID NO: 894 - protein, 7 aa, Artificial Sequence
  Description of Artificial Sequence: Synthetic peptide
NNNDNDN

SEQ ID NO: 895 - protein, 7 aa, Artificial Sequence
  Description of Artificial Sequence: Synthetic peptide
NNNDNND

SEQ ID NO: 896 - protein, 7 aa, Artificial Sequence
  Description of Artificial Sequence: Synthetic peptide
NNNNDDN

SEQ ID NO: 897 - protein, 7 aa, Artificial Sequence
  Description of Artificial Sequence: Synthetic peptide
NNNNDND

SEQ ID NO: 898 - protein, 7 aa, Artificial Sequence
  Description of Artificial Sequence: Synthetic peptide
NNNNNND

SEQ ID NO: 899 - protein, 7 aa, Artificial Sequence
  Description of Artificial Sequence: Synthetic peptide
DNNNNNN

SEQ ID NO: 900 - protein, 7 aa, Artificial Sequence
  Description of Artificial Sequence: Synthetic peptide
NDNNNNN

SEQ ID NO: 901 - protein, 7 aa, Artificial Sequence
  Description of Artificial Sequence: Synthetic peptide
NNDNNNN

SEQ ID NO: 902 - protein, 7 aa, Artificial Sequence
  Description of Artificial Sequence: Synthetic peptide
NNNDNNN

SEQ ID NO: 903 - protein, 7 aa, Artificial Sequence
  Description of Artificial Sequence: Synthetic peptide
NNNNDNN

SEQ ID NO: 904 - protein, 7 aa, Artificial Sequence
  Description of Artificial Sequence: Synthetic peptide
NNNNNDN

SEQ ID NO: 905 - protein, 4 aa, Artificial Sequence
  Description of Artificial Sequence: Synthetic peptide
GGGT

SEQ ID NO: 906 - protein, 4 aa, Artificial Sequence
  Description of Artificial Sequence: Synthetic peptide
TGGG

SEQ ID NO: 907 - protein, 4 aa, Artificial Sequence
  Description of Artificial Sequence: Synthetic peptide
GTGG

SEQ ID NO: 908 - protein, 4 aa, Artificial Sequence
  Description of Artificial Sequence: Synthetic peptide
GGTG

SEQ ID NO: 909 - protein, 5 aa, Artificial Sequence
  Description of Artificial Sequence: Synthetic peptide
GGGGT

SEQ ID NO: 910 - protein, 5 aa, Artificial Sequence
  Description of Artificial Sequence: Synthetic peptide
TGGGG

SEQ ID NO: 911 - protein, 5 aa, Artificial Sequence
  Description of Artificial Sequence: Synthetic peptide
GTGGG

SEQ ID NO: 912 - protein, 5 aa, Artificial Sequence
  Description of Artificial Sequence: Synthetic peptide
GGTGG

SEQ ID NO: 913 - protein, 5 aa, Artificial Sequence
  Description of Artificial Sequence: Synthetic peptide
GGGTG

SEQ ID NO: 914 - protein, 5 aa, Artificial Sequence
  Description of Artificial Sequence: Synthetic peptide
GGGTT

SEQ ID NO: 915 - protein, 5 aa, Artificial Sequence
  Description of Artificial Sequence: Synthetic peptide
TTGGG

SEQ ID NO: 916 - protein, 5 aa, Artificial Sequence
  Description of Artificial Sequence: Synthetic peptide
TGTGG

SEQ ID NO: 917 - protein, 5 aa, Artificial Sequence
  Description of Artificial Sequence: Synthetic peptide
TGGTG

SEQ ID NO: 918 - protein, 5 aa, Artificial Sequence
  Description of Artificial Sequence: Synthetic peptide
TGGGT

SEQ ID NO: 919 - protein, 5 aa, Artificial Sequence
  Description of Artificial Sequence: Synthetic peptide
GTTGG

SEQ ID NO: 920 - protein, 5 aa, Artificial Sequence
  Description of Artificial Sequence: Synthetic peptide
GTGTG

SEQ ID NO: 921 - protein, 5 aa, Artificial Sequence
  Description of Artificial Sequence: Synthetic peptide
GTGGT

SEQ ID NO: 922 - protein, 5 aa, Artificial Sequence
  Description of Artificial Sequence: Synthetic peptide
GGTTG

SEQ ID NO: 923 - protein, 5 aa, Artificial Sequence
  Description of Artificial Sequence: Synthetic peptide
GGTGT

SEQ ID NO: 924 - protein, 6 aa, Artificial Sequence
  Description of Artificial Sequence: Synthetic peptide
GGGGGT

SEQ ID NO: 925 - protein, 6 aa, Artificial Sequence
  Description of Artificial Sequence: Synthetic peptide
TGGGGG

SEQ ID NO: 926 - protein, 6 aa, Artificial Sequence
  Description of Artificial Sequence: Synthetic peptide
GTGGGG

SEQ ID NO: 927 - protein, 6 aa, Artificial Sequence
  Description of Artificial Sequence: Synthetic peptide
GGTGGG

SEQ ID NO: 928 - protein, 6 aa, Artificial Sequence
  Description of Artificial Sequence: Synthetic peptide
GGGTGG

SEQ ID NO: 929 - protein, 6 aa, Artificial Sequence
  Description of Artificial Sequence: Synthetic peptide
GGGGTG

SEQ ID NO: 930 - protein, 6 aa, Artificial Sequence
  Description of Artificial Sequence: Synthetic peptide
GGGGTT

SEQ ID NO: 931 - protein, 6 aa, Artificial Sequence
  Description of Artificial Sequence: Synthetic peptide
TTGGGG

SEQ ID NO: 932 - protein, 6 aa, Artificial Sequence
  Description of Artificial Sequence: Synthetic peptide
TGTGGG

SEQ ID NO: 933 - protein, 6 aa, Artificial Sequence
  Description of Artificial Sequence: Synthetic peptide
TGGTGG

SEQ ID NO: 934 - protein, 6 aa, Artificial Sequence
  Description of Artificial Sequence: Synthetic peptide
TGGGTG

SEQ ID NO: 935 - protein, 6 aa, Artificial Sequence
  Description of Artificial Sequence: Synthetic peptide
TGGGGT

SEQ ID NO: 936 - protein, 6 aa, Artificial Sequence
  Description of Artificial Sequence: Synthetic peptide
GTTGGG

SEQ ID NO: 937 - protein, 6 aa, Artificial Sequence
  Description of Artificial Sequence: Synthetic peptide
GTGTGG

SEQ ID NO: 938 - protein, 6 aa, Artificial Sequence
  Description of Artificial Sequence: Synthetic peptide
GTGGTG

SEQ ID NO: 939 - protein, 6 aa, Artificial Sequence
  Description of Artificial Sequence: Synthetic peptide
GTGGGT

SEQ ID NO: 940 - protein, 6 aa, Artificial Sequence
  Description of Artificial Sequence: Synthetic peptide
GGTTGG

SEQ ID NO: 941 - protein, 6 aa, Artificial Sequence
  Description of Artificial Sequence: Synthetic peptide
GGTGTG

SEQ ID NO: 942 - protein, 6 aa, Artificial Sequence
  Description of Artificial Sequence: Synthetic peptide
GGTGGT

SEQ ID NO: 943 - protein, 6 aa, Artificial Sequence
  Description of Artificial Sequence: Synthetic peptide
GGGTTG

SEQ ID NO: 944 - protein, 6 aa, Artificial Sequence
  Description of Artificial Sequence: Synthetic peptide
GGGTGT

SEQ ID NO: 945 - protein, 7 aa, Artificial Sequence
  Description of Artificial Sequence: Synthetic peptide
GGGGTTT

SEQ ID NO: 946 - protein, 7 aa, Artificial Sequence
  Description of Artificial Sequence: Synthetic peptide
TTTGGGG

SEQ ID NO: 947 - protein, 7 aa, Artificial Sequence
  Description of Artificial Sequence: Synthetic peptide
TGTTGGG

SEQ ID NO: 948 - protein, 7 aa, Artificial Sequence
  Description of Artificial Sequence: Synthetic peptide
TGTGTGG

SEQ ID NO: 949 - protein, 7 aa, Artificial Sequence
  Description of Artificial Sequence: Synthetic peptide
TGTGGTG

SEQ ID NO: 950 - protein, 7 aa, Artificial Sequence
  Description of Artificial Sequence: Synthetic peptide
TGTGGGT

SEQ ID NO: 951 - protein, 7 aa, Artificial Sequence
  Description of Artificial Sequence: Synthetic peptide
TGGTTGG

SEQ ID NO: 952 - protein, 7 aa, Artificial Sequence
  Description of Artificial Sequence: Synthetic peptide
TGGTGTG

SEQ ID NO: 953 - protein, 7 aa, Artificial Sequence
  Description of Artificial Sequence: Synthetic peptide
TGGTGGT

SEQ ID NO: 954 - protein, 7 aa, Artificial Sequence
  Description of Artificial Sequence: Synthetic peptide
TGGGTGT

SEQ ID NO: 955 - protein, 7 aa, Artificial Sequence
  Description of Artificial Sequence: Synthetic peptide
TGGGTTG

SEQ ID NO: 956 - protein, 7 aa, Artificial Sequence
  Description of Artificial Sequence: Synthetic peptide
TGGGGTT

SEQ ID NO: 957 - protein, 7 aa, Artificial Sequence
  Description of Artificial Sequence: Synthetic peptide
TTGTGGG

SEQ ID NO: 958 - protein, 7 aa, Artificial Sequence
  Description of Artificial Sequence: Synthetic peptide
TTGGTGG

SEQ ID NO: 959 - protein, 7 aa, Artificial Sequence
  Description of Artificial Sequence: Synthetic peptide
TTGGGTG

SEQ ID NO: 960 - protein, 7 aa, Artificial Sequence
  Description of Artificial Sequence: Synthetic peptide
TTGGGGT

SEQ ID NO: 961 - protein, 7 aa, Artificial Sequence
  Description of Artificial Sequence: Synthetic peptide
GTTTGGG

SEQ ID NO: 962 - protein, 7 aa, Artificial Sequence
  Description of Artificial Sequence: Synthetic peptide
GTTGTGG

SEQ ID NO: 963 - protein, 7 aa, Artificial Sequence
  Description of Artificial Sequence: Synthetic peptide
GTTGGTG

SEQ ID NO: 964 - protein, 7 aa, Artificial Sequence
  Description of Artificial Sequence: Synthetic peptide
GTTGGGT

SEQ ID NO: 965 - protein, 7 aa, Artificial Sequence
  Description of Artificial Sequence: Synthetic peptide
GTGTTGG

SEQ ID NO: 966 - protein, 7 aa, Artificial Sequence
  Description of Artificial Sequence: Synthetic peptide
GTGGTTG

SEQ ID NO: 967 - protein, 7 aa, Artificial Sequence
  Description of Artificial Sequence: Synthetic peptide
GTGGGTT

SEQ ID NO: 968 - protein, 7 aa, Artificial Sequence
  Description of Artificial Sequence: Synthetic peptide
GTGTGTG

SEQ ID NO: 969 - protein, 7 aa, Artificial Sequence
  Description of Artificial Sequence: Synthetic peptide
GTGTGGT

SEQ ID NO: 970 - protein, 7 aa, Artificial Sequence
  Description of Artificial Sequence: Synthetic peptide
GTGGTGT

SEQ ID NO: 971 - protein, 7 aa, Artificial Sequence
  Description of Artificial Sequence: Synthetic peptide
GGTTTGG

SEQ ID NO: 972 - protein, 7 aa, Artificial Sequence
  Description of Artificial Sequence: Synthetic peptide
GGTTGTG

SEQ ID NO: 973 - protein, 7 aa, Artificial Sequence
  Description of Artificial Sequence: Synthetic peptide
GGTTGGT

SEQ ID NO: 974 - protein, 7 aa, Artificial Sequence
  Description of Artificial Sequence: Synthetic peptide
GGTGTTG

SEQ ID NO: 975 - protein, 7 aa, Artificial Sequence
  Description of Artificial Sequence: Synthetic peptide
GGTGTGT

SEQ ID NO: 976 - protein, 7 aa, Artificial Sequence
  Description of Artificial Sequence: Synthetic peptide
GGTGGTT

SEQ ID NO: 977 - protein, 7 aa, Artificial Sequence
  Description of Artificial Sequence: Synthetic peptide
GGGTTTG

SEQ ID NO: 978 - protein, 7 aa, Artificial Sequence
  Description of Artificial Sequence: Synthetic peptide
GGGTTGT

SEQ ID NO: 979 - protein, 7 aa, Artificial Sequence
  Description of Artificial Sequence: Synthetic peptide
GGGTGTT

SEQ ID NO: 980 - protein, 7 aa, Artificial Sequence
  Description of Artificial Sequence: Synthetic peptide
GGGGGTT

SEQ ID NO: 981 - protein, 7 aa, Artificial Sequence
  Description of Artificial Sequence: Synthetic peptide
TTGGGGG

SEQ ID NO: 982 - protein, 7 aa, Artificial Sequence
  Description of Artificial Sequence: Synthetic peptide
TGTGGGG

SEQ ID NO: 983 - protein, 7 aa, Artificial Sequence
  Description of Artificial Sequence: Synthetic peptide
TGGTGGG

SEQ ID NO: 984 - protein, 7 aa, Artificial Sequence
  Description of Artificial Sequence: Synthetic peptide
TGGGTGG

SEQ ID NO: 985 - protein, 7 aa, Artificial Sequence
  Description of Artificial Sequence: Synthetic peptide
TGGGGTG

SEQ ID NO: 986 - protein, 7 aa, Artificial Sequence
  Description of Artificial Sequence: Synthetic peptide
TGGGGGT

SEQ ID NO: 987 - protein, 7 aa, Artificial Sequence
  Description of Artificial Sequence: Synthetic peptide
GTTGGGG

SEQ ID NO: 988 - protein, 7 aa, Artificial Sequence
  Description of Artificial Sequence: Synthetic peptide
GTGTGGG

SEQ ID NO: 989 - protein, 7 aa, Artificial Sequence
  Description of Artificial Sequence: Synthetic peptide
GTGGTGG

SEQ ID NO: 990 - protein, 7 aa, Artificial Sequence
  Description of Artificial Sequence: Synthetic peptide
GTGGGTG

SEQ ID NO: 991 - protein, 7 aa, Artificial Sequence
  Description of Artificial Sequence: Synthetic peptide
GTGGGGT

SEQ ID NO: 992 - protein, 7 aa, Artificial Sequence
  Description of Artificial Sequence: Synthetic peptide
GGTTGGG

SEQ ID NO: 993 - protein, 7 aa, Artificial Sequence
  Description of Artificial Sequence: Synthetic peptide
GGTGTGG

SEQ ID NO: 994 - protein, 7 aa, Artificial Sequence
  Description of Artificial Sequence: Synthetic peptide
GGTGGTG

SEQ ID NO: 995 - protein, 7 aa, Artificial Sequence
  Description of Artificial Sequence: Synthetic peptide
GGTGGGT

SEQ ID NO: 996 - protein, 7 aa, Artificial Sequence
  Description of Artificial Sequence: Synthetic peptide
GGGTTGG

SEQ ID NO: 997 - protein, 7 aa, Artificial Sequence
  Description of Artificial Sequence: Synthetic peptide
GGGTGTG

SEQ ID NO: 998 - protein, 7 aa, Artificial Sequence
  Description of Artificial Sequence: Synthetic peptide
GGGTGGT

SEQ ID NO: 999 - protein, 7 aa, Artificial Sequence
  Description of Artificial Sequence: Synthetic peptide
GGGGTTG

SEQ ID NO: 1000 - protein, 7 aa, Artificial Sequence
  Description of Artificial Sequence: Synthetic peptide
GGGGTGT

SEQ ID NO: 1001 - protein, 7 aa, Artificial Sequence
  Description of Artificial Sequence: Synthetic peptide
GGGGGGT

SEQ ID NO: 1002 - protein, 7 aa, Artificial Sequence
  Description of Artificial Sequence: Synthetic peptide
TGGGGGG

SEQ ID NO: 1003 - protein, 7 aa, Artificial Sequence
  Description of Artificial Sequence: Synthetic peptide
GTGGGGG

SEQ ID NO: 1004 - protein, 7 aa, Artificial Sequence
  Description of Artificial Sequence: Synthetic peptide
GGTGGGG

SEQ ID NO: 1005 - protein, 7 aa, Artificial Sequence
  Description of Artificial Sequence: Synthetic peptide
GGGTGGG

SEQ ID NO: 1006 - protein, 7 aa, Artificial Sequence
  Description of Artificial Sequence: Synthetic peptide
GGGGTGG

SEQ ID NO: 1007 - protein, 7 aa, Artificial Sequence
  Description of Artificial Sequence: Synthetic peptide
GGGGGTG

SEQ ID NO: 1008 - protein, 4 aa, Artificial Sequence
  Description of Artificial Sequence: Synthetic peptide
GGGA

SEQ ID NO: 1009 - protein, 4 aa, Artificial Sequence
  Description of Artificial Sequence: Synthetic peptide
AGGG

SEQ ID NO: 1010 - protein, 4 aa, Artificial Sequence
  Description of Artificial Sequence: Synthetic peptide
GAGG

SEQ ID NO: 1011 - protein, 4 aa, Artificial Sequence
  Description of Artificial Sequence: Synthetic peptide
GGAG

SEQ ID NO: 1012 - protein, 5 aa, Artificial Sequence
  Description of Artificial Sequence: Synthetic peptide
GGGGA

SEQ ID NO: 1013 - protein, 5 aa, Artificial Sequence
  Description of Artificial Sequence: Synthetic peptide
AGGGG

SEQ ID NO: 1014 - protein, 5 aa, Artificial Sequence
  Description of Artificial Sequence: Synthetic peptide
GAGGG

SEQ ID NO: 1015 - protein, 5 aa, Artificial Sequence
  Description of Artificial Sequence: Synthetic peptide
GGAGG

SEQ ID NO: 1016 - protein, 5 aa, Artificial Sequence
  Description of Artificial Sequence: Synthetic peptide
GGGAG

SEQ ID NO: 1017 - protein, 5 aa, Artificial Sequence
  Description of Artificial Sequence: Synthetic peptide
GGGAA

SEQ ID NO: 1018 - protein, 5 aa, Artificial Sequence
  Description of Artificial Sequence: Synthetic peptide
AAGGG

SEQ ID NO: 1019 - protein, 5 aa, Artificial Sequence
  Description of Artificial Sequence: Synthetic peptide
AGAGG

SEQ ID NO: 1020 - protein, 5 aa, Artificial Sequence
  Description of Artificial Sequence: Synthetic peptide
AGGAG

SEQ ID NO: 1021 - protein, 5 aa, Artificial Sequence
  Description of Artificial Sequence: Synthetic peptide
AGGGA

SEQ ID NO: 1022 - protein, 5 aa, Artificial Sequence
  Description of Artificial Sequence: Synthetic peptide
GAAGG

SEQ ID NO: 1023 - protein, 5 aa, Artificial Sequence
  Description of Artificial Sequence: Synthetic peptide
GAGAG

SEQ ID NO: 1024 - protein, 5 aa, Artificial Sequence
  Description of Artificial Sequence: Synthetic peptide
GAGGA

SEQ ID NO: 1025 - protein, 5 aa, Artificial Sequence
  Description of Artificial Sequence: Synthetic peptide
GGAAG

SEQ ID NO: 1026 - protein, 5 aa, Artificial Sequence
  Description of Artificial Sequence: Synthetic peptide
GGAGA

SEQ ID NO: 1027 - protein, 6 aa, Artificial Sequence
  Description of Artificial Sequence: Synthetic peptide
GGGGGA

SEQ ID NO: 1028 - protein, 6 aa, Artificial Sequence
  Description of Artificial Sequence: Synthetic peptide
AGGGGG

SEQ ID NO: 1029 - protein, 6 aa, Artificial Sequence
  Description of Artificial Sequence: Synthetic peptide
GAGGGG

SEQ ID NO: 1030 - protein, 6 aa, Artificial Sequence
  Description of Artificial Sequence: Synthetic peptide
GGAGGG

SEQ ID NO: 1031 - protein, 6 aa, Artificial Sequence
  Description of Artificial Sequence: Synthetic peptide
GGGAGG

SEQ ID NO: 1032 - protein, 6 aa, Artificial Sequence
  Description of Artificial Sequence: Synthetic peptide
GGGGAG

SEQ ID NO: 1033 - protein, 6 aa, Artificial Sequence
  Description of Artificial Sequence: Synthetic peptide
GGGGAA

SEQ ID NO: 1034 - protein, 6 aa, Artificial Sequence
  Description of Artificial Sequence: Synthetic peptide
AAGGGG

SEQ ID NO: 1035 - protein, 6 aa, Artificial Sequence
  Description of Artificial Sequence: Synthetic peptide
AGAGGG

SEQ ID NO: 1036 - protein, 6 aa, Artificial Sequence
  Description of Artificial Sequence: Synthetic peptide
AGGAGG

SEQ ID NO: 1037 - protein, 6 aa, Artificial Sequence
  Description of Artificial Sequence: Synthetic peptide
AGGGAG

SEQ ID NO: 1038 - protein, 6 aa, Artificial Sequence
  Description of Artificial Sequence: Synthetic peptide
AGGGGA

SEQ ID NO: 1039 - protein, 6 aa, Artificial Sequence
  Description of Artificial Sequence: Synthetic peptide
GAAGGG

SEQ ID NO: 1040 - protein, 6 aa, Artificial Sequence
  Description of Artificial Sequence: Synthetic peptide
GAGAGG

SEQ ID NO: 1041 - protein, 6 aa, Artificial Sequence
  Description of Artificial Sequence: Synthetic peptide
GAGGAG

SEQ ID NO: 1042 - protein, 6 aa, Artificial Sequence
  Description of Artificial Sequence: Synthetic peptide
GAGGGA

SEQ ID NO: 1043 - protein, 6 aa, Artificial Sequence
  Description of Artificial Sequence: Synthetic peptide
GGAAGG

SEQ ID NO: 1044 - protein, 6 aa, Artificial Sequence
  Description of Artificial Sequence: Synthetic peptide
GGAGAG

SEQ ID NO: 1045 - protein, 6 aa, Artificial Sequence
  Description of Artificial Sequence: Synthetic peptide
GGAGGA

SEQ ID NO: 1046 - protein, 6 aa, Artificial Sequence
  Description of Artificial Sequence: Synthetic peptide
GGGAAG

SEQ ID NO: 1047 - protein, 6 aa, Artificial Sequence
  Description of Artificial Sequence: Synthetic peptide
GGGAGA

SEQ ID NO: 1048 - protein, 7 aa, Artificial Sequence
  Description of Artificial Sequence: Synthetic peptide
GGGGAAA

SEQ ID NO: 1049 - protein, 7 aa, Artificial Sequence
  Description of Artificial Sequence: Synthetic peptide
AAAGGGG

SEQ ID NO: 1050 - protein, 7 aa, Artificial Sequence
  Description of Artificial Sequence: Synthetic peptide
AGAAGGG

SEQ ID NO: 1051 - protein, 7 aa, Artificial Sequence
  Description of Artificial Sequence: Synthetic peptide
AGAGAGG

SEQ ID NO: 1052 - protein, 7 aa, Artificial Sequence
  Description of Artificial Sequence: Synthetic peptide
AGAGGAG

SEQ ID NO: 1053 - protein, 7 aa, Artificial Sequence
  Description of Artificial Sequence: Synthetic peptide
AGAGGGA

SEQ ID NO: 1054 - protein, 7 aa, Artificial Sequence
  Description of Artificial Sequence: Synthetic peptide
AGGAAGG

SEQ ID NO: 1055 - protein, 7 aa, Artificial Sequence
  Description of Artificial Sequence: Synthetic peptide
AGGAGAG

SEQ ID NO: 1056 - protein, 7 aa, Artificial Sequence
  Description of Artificial Sequence: Synthetic peptide
AGGAGGA

SEQ ID NO: 1057 - protein, 7 aa, Artificial Sequence
  Description of Artificial Sequence: Synthetic peptide
AGGGAGA

SEQ ID NO: 1058 - protein, 7 aa, Artificial Sequence
  Description of Artificial Sequence: Synthetic peptide
AGGGAAG

SEQ ID NO: 1059 - protein, 7 aa, Artificial Sequence
  Description of Artificial Sequence: Synthetic peptide
AGGGGAA

SEQ ID NO: 1060 - protein, 7 aa, Artificial Sequence
  Description of Artificial Sequence: Synthetic peptide
AAGAGGG

SEQ ID NO: 1061 - protein, 7 aa, Artificial Sequence
  Description of Artificial Sequence: Synthetic peptide
AAGGAGG

SEQ ID NO: 1062 - protein, 7 aa, Artificial Sequence
  Description of Artificial Sequence: Synthetic peptide
AAGGGAG

SEQ ID NO: 1063 - protein, 7 aa, Artificial Sequence
  Description of Artificial Sequence: Synthetic peptide
AAGGGGA

SEQ ID NO: 1064 - protein, 7 aa, Artificial Sequence
  Description of Artificial Sequence: Synthetic peptide
GAAAGGG

SEQ ID NO: 1065 - protein, 7 aa, Artificial Sequence
  Description of Artificial Sequence: Synthetic peptide
GAAGAGG

SEQ ID NO: 1066 - protein, 7 aa, Artificial Sequence
  Description of Artificial Sequence: Synthetic peptide
GAAGGAG

SEQ ID NO: 1067 - protein, 7 aa, Artificial Sequence
  Description of Artificial Sequence: Synthetic peptide
GAAGGGA

SEQ ID NO: 1068 - protein, 7 aa, Artificial Sequence
  Description of Artificial Sequence: Synthetic peptide
GAGAAGG

SEQ ID NO: 1069 - protein, 7 aa, Artificial Sequence
  Description of Artificial Sequence: Synthetic peptide
GAGGAAG

SEQ ID NO: 1070 - protein, 7 aa, Artificial Sequence
  Description of Artificial Sequence: Synthetic peptide
GAGGGAA

SEQ ID NO: 1071 - protein, 7 aa, Artificial Sequence
  Description of Artificial Sequence: Synthetic peptide
GAGAGAG

SEQ ID NO: 1072 - protein, 7 aa, Artificial Sequence
  Description of Artificial Sequence: Synthetic peptide
GAGAGGA

SEQ ID NO: 1073 - protein, 7 aa, Artificial Sequence
  Description of Artificial Sequence: Synthetic peptide
GAGGAGA

SEQ ID NO: 1074 - protein, 7 aa, Artificial Sequence
  Description of Artificial Sequence: Synthetic peptide
GGAAAGG

SEQ ID NO: 1075 - protein, 7 aa, Artificial Sequence
  Description of Artificial Sequence: Synthetic peptide
GGAAGAG

SEQ ID NO: 1076 - protein, 7 aa, Artificial Sequence
  Description of Artificial Sequence: Synthetic peptide
GGAAGGA

SEQ ID NO: 1077 - protein, 7 aa, Artificial Sequence
  Description of Artificial Sequence: Synthetic peptide
GGAGAAG

SEQ ID NO: 1078 - protein, 7 aa, Artificial Sequence
  Description of Artificial Sequence: Synthetic peptide
GGAGAGA

SEQ ID NO: 1079 - protein, 7 aa, Artificial Sequence
  Description of Artificial Sequence: Synthetic peptide
GGAGGAA

SEQ ID NO: 1080 - protein, 7 aa, Artificial Sequence
  Description of Artificial Sequence: Synthetic peptide
GGGAAAG

SEQ ID NO: 1081 - protein, 7 aa, Artificial Sequence
  Description of Artificial Sequence: Synthetic peptide
GGGAAGA

SEQ ID NO: 1082 - protein, 7 aa, Artificial Sequence
  Description of Artificial Sequence: Synthetic peptide
GGGAGAA

SEQ ID NO: 1083 - protein, 7 aa, Artificial Sequence
  Description of Artificial Sequence: Synthetic peptide
GGGGGAA

SEQ ID NO: 1084 - protein, 7 aa, Artificial Sequence
  Description of Artificial Sequence: Synthetic peptide
AAGGGGG

SEQ ID NO: 1085 - protein, 7 aa, Artificial Sequence
  Description of Artificial Sequence: Synthetic peptide
AGAGGGG

SEQ ID NO: 1086 - protein, 7 aa, Artificial Sequence
  Description of Artificial Sequence: Synthetic peptide
AGGAGGG

SEQ ID NO: 1087 - protein, 7 aa, Artificial Sequence
  Description of Artificial Sequence: Synthetic peptide
AGGGAGG

SEQ ID NO: 1088 - protein, 7 aa, Artificial Sequence
  Description of Artificial Sequence: Synthetic peptide
AGGGGAG

SEQ ID NO: 1089 - protein, 7 aa, Artificial Sequence
  Description of Artificial Sequence: Synthetic peptide
AGGGGGA

SEQ ID NO: 1090 - protein, 7 aa, Artificial Sequence
  Description of Artificial Sequence: Synthetic peptide
GAAGGGG

SEQ ID NO: 1091 - protein, 7 aa, Artificial Sequence
  Description of Artificial Sequence: Synthetic peptide
GAGAGGG

SEQ ID NO: 1092 - protein, 7 aa, Artificial Sequence
  Description of Artificial Sequence: Synthetic peptide
GAGGAGG

SEQ ID NO: 1093 - protein, 7 aa, Artificial Sequence
  Description of Artificial Sequence: Synthetic peptide
GAGGGAG

SEQ ID NO: 1094 - protein, 7 aa, Artificial Sequence
  Description of Artificial Sequence: Synthetic peptide
GAGGGGA

SEQ ID NO: 1095 - protein, 7 aa, Artificial Sequence
  Description of Artificial Sequence: Synthetic peptide
GGAAGGG

SEQ ID NO: 1096 - protein, 7 aa, Artificial Sequence
  Description of Artificial Sequence: Synthetic peptide
GGAGAGG

SEQ ID NO: 1097 - protein, 7 aa, Artificial Sequence
  Description of Artificial Sequence: Synthetic peptide
GGAGGAG

SEQ ID NO: 1098 - protein, 7 aa, Artificial Sequence
  Description of Artificial Sequence: Synthetic peptide
GGAGGGA

SEQ ID NO: 1099 - protein, 7 aa, Artificial Sequence
  Description of Artificial Sequence: Synthetic peptide
GGGAAGG

SEQ ID NO: 1100 - protein, 7 aa, Artificial Sequence
  Description of Artificial Sequence: Synthetic peptide
GGGAGAG

SEQ ID NO: 1101 - protein, 7 aa, Artificial Sequence
  Description of Artificial Sequence: Synthetic peptide
GGGAGGA

SEQ ID NO: 1102 - protein, 7 aa, Artificial Sequence
  Description of Artificial Sequence: Synthetic peptide
GGGGAAG

SEQ ID NO: 1103 - protein, 7 aa, Artificial Sequence
  Description of Artificial Sequence: Synthetic peptide
GGGGAGA

SEQ ID NO: 1104 - protein, 7 aa, Artificial Sequence
  Description of Artificial Sequence: Synthetic peptide
GGGGGGA

SEQ ID NO: 1105 - protein, 7 aa, Artificial Sequence
  Description of Artificial Sequence: Synthetic peptide
AGGGGGG

SEQ ID NO: 1106 - protein, 7 aa, Artificial Sequence
  Description of Artificial Sequence: Synthetic peptide
GAGGGGG

SEQ ID NO: 1107 - protein, 7 aa, Artificial Sequence
  Description of Artificial Sequence: Synthetic peptide
GGAGGGG

SEQ ID NO: 1108 - protein, 7 aa, Artificial Sequence
  Description of Artificial Sequence: Synthetic peptide
GGGAGGG

SEQ ID NO: 1109 - protein, 7 aa, Artificial Sequence
  Description of Artificial Sequence: Synthetic peptide
GGGGAGG

SEQ ID NO: 1110 - protein, 7 aa, Artificial Sequence
  Description of Artificial Sequence: Synthetic peptide
GGGGGAG

SEQ ID NO: 1111 - protein, 4 aa, Artificial Sequence
  Description of Artificial Sequence: Synthetic peptide
GGGS

SEQ ID NO: 1112 - protein, 4 aa, Artificial Sequence
  Description of Artificial Sequence: Synthetic peptide
SGGG

SEQ ID NO: 1113 - protein, 4 aa, Artificial Sequence
  Description of Artificial Sequence: Synthetic peptide
GSGG

SEQ ID NO: 1114 - protein, 4 aa, Artificial Sequence
  Description of Artificial Sequence: Synthetic peptide
GGSG

SEQ ID NO: 1115 - protein, 5 aa, Artificial Sequence
  Description of Artificial Sequence: Synthetic peptide
GGGGS

SEQ ID NO: 1116 - protein, 5 aa, Artificial Sequence
  Description of Artificial Sequence: Synthetic peptide
SGGGG

SEQ ID NO: 1117 - protein, 5 aa, Artificial Sequence
  Description of Artificial Sequence: Synthetic peptide
GSGGG

SEQ ID NO: 1118 - protein, 5 aa, Artificial Sequence
  Description of Artificial Sequence: Synthetic peptide
GGSGG

SEQ ID NO: 1119 - protein, 5 aa, Artificial Sequence
  Description of Artificial Sequence: Synthetic peptide
GGGSG

SEQ ID NO: 1120 - protein, 5 aa, Artificial Sequence
  Description of Artificial Sequence: Synthetic peptide
GGGSS

SEQ ID NO: 1121 - protein, 5 aa, Artificial Sequence
  Description of Artificial Sequence: Synthetic peptide
SSGGG

SEQ ID NO: 1122 - protein, 5 aa, Artificial Sequence
  Description of Artificial Sequence: Synthetic peptide
SGSGG

SEQ ID NO: 1123 - protein, 5 aa, Artificial Sequence
  Description of Artificial Sequence: Synthetic peptide
SGGSG

SEQ ID NO: 1124 - protein, 5 aa, Artificial Sequence
  Description of Artificial Sequence: Synthetic peptide
SGGGS

SEQ ID NO: 1125 - protein, 5 aa, Artificial Sequence
  Description of Artificial Sequence: Synthetic peptide
GSSGG

SEQ ID NO: 1126 - protein, 5 aa, Artificial Sequence
  Description of Artificial Sequence: Synthetic peptide
GSGSG

SEQ ID NO: 1127 - protein, 5 aa, Artificial Sequence
  Description of Artificial Sequence: Synthetic peptide
GSGGS

SEQ ID NO: 1128 - protein, 5 aa, Artificial Sequence
  Description of Artificial Sequence: Synthetic peptide
GGSSG

SEQ ID NO: 1129 - protein, 5 aa, Artificial Sequence
  Description of Artificial Sequence: Synthetic peptide
GGSGS

SEQ ID NO: 1130 - protein, 6 aa, Artificial Sequence
  Description of Artificial Sequence: Synthetic peptide
GGGGGS

SEQ ID NO: 1131 - protein, 6 aa, Artificial Sequence
  Description of Artificial Sequence: Synthetic peptide
SGGGGG

SEQ ID NO: 1132 - protein, 6 aa, Artificial Sequence
  Description of Artificial Sequence: Synthetic peptide
GSGGGG

SEQ ID NO: 1133 - protein, 6 aa, Artificial Sequence
  Description of Artificial Sequence: Synthetic peptide
GGSGGG

SEQ ID NO: 1134 - protein, 6 aa, Artificial Sequence
  Description of Artificial Sequence: Synthetic peptide
GGGSGG

SEQ ID NO: 1135 - protein, 6 aa, Artificial Sequence
  Description of Artificial Sequence: Synthetic peptide
GGGGSG

SEQ ID NO: 1136 - protein, 6 aa, Artificial Sequence
  Description of Artificial Sequence: Synthetic peptide
GGGGSS

SEQ ID NO: 1137 - protein, 6 aa, Artificial Sequence
  Description of Artificial Sequence: Synthetic peptide
SSGGGG

SEQ ID NO: 1138 - protein, 6 aa, Artificial Sequence
  Description of Artificial Sequence: Synthetic peptide
SGSGGG

SEQ ID NO: 1139 - protein, 6 aa, Artificial Sequence
  Description of Artificial Sequence: Synthetic peptide
SGGSGG

SEQ ID NO: 1140 - protein, 6 aa, Artificial Sequence
  Description of Artificial Sequence: Synthetic peptide
SGGGSG

SEQ ID NO: 1141 - protein, 6 aa, Artificial Sequence
  Description of Artificial Sequence: Synthetic peptide
SGGGGS

SEQ ID NO: 1142 - protein, 6 aa, Artificial Sequence
  Description of Artificial Sequence: Synthetic peptide
GSSGGG

SEQ ID NO: 1143 - protein, 6 aa, Artificial Sequence
  Description of Artificial Sequence: Synthetic peptide
GSGSGG

SEQ ID NO: 1144 - protein, 6 aa, Artificial Sequence
  Description of Artificial Sequence: Synthetic peptide
GSGGSG

SEQ ID NO: 1145 - protein, 6 aa, Artificial Sequence
  Description of Artificial Sequence: Synthetic peptide
GSGGGS

SEQ ID NO: 1146 - protein, 6 aa, Artificial Sequence
  Description of Artificial Sequence: Synthetic peptide
GGSSGG

SEQ ID NO: 1147 - protein, 6 aa, Artificial Sequence
  Description of Artificial Sequence: Synthetic peptide
GGSGSG

SEQ ID NO: 1148 - protein, 6 aa, Artificial Sequence
  Description of Artificial Sequence: Synthetic peptide
GGSGGS

SEQ ID NO: 1149 - protein, 6 aa, Artificial Sequence
  Description of Artificial Sequence: Synthetic peptide
GGGSSG

SEQ ID NO: 1150 - protein, 6 aa, Artificial Sequence
  Description of Artificial Sequence: Synthetic peptide
GGGSGS

SEQ ID NO: 1151 - protein, 7 aa, Artificial Sequence
  Description of Artificial Sequence: Synthetic peptide
GGGGSSS

SEQ ID NO: 1152 - protein, 7 aa, Artificial Sequence
  Description of Artificial Sequence: Synthetic peptide
SSSGGGG

SEQ ID NO: 1153 - protein, 7 aa, Artificial Sequence
  Description of Artificial Sequence: Synthetic peptide
SGSSGGG

SEQ ID NO: 1154 - protein, 7 aa, Artificial Sequence
  Description of Artificial Sequence: Synthetic peptide
SGSGSGG

SEQ ID NO: 1155 - protein, 7 aa, Artificial Sequence
  Description of Artificial Sequence: Synthetic peptide
SGSGGSG

SEQ ID NO: 1156 - protein, 7 aa, Artificial Sequence
  Description of Artificial Sequence: Synthetic peptide
SGSGGGS

SEQ ID NO: 1157 - protein, 7 aa, Artificial Sequence
  Description of Artificial Sequence: Synthetic peptide
SGGSSGG

SEQ ID NO: 1158 - protein, 7 aa, Artificial Sequence
  Description of Artificial Sequence: Synthetic peptide
SGGSGSG

SEQ ID NO: 1159 - protein, 7 aa, Artificial Sequence
  Description of Artificial Sequence: Synthetic peptide
SGGSGGS

SEQ ID NO: 1160 - protein, 7 aa, Artificial Sequence
  Description of Artificial Sequence: Synthetic peptide
SGGGSGS

SEQ ID NO: 1161 - protein, 7 aa, Artificial Sequence
  Description of Artificial Sequence: Synthetic peptide
SGGGSSG

SEQ ID NO: 1162 - protein, 7 aa, Artificial Sequence
  Description of Artificial Sequence: Synthetic peptide
SGGGGSS

SEQ ID NO: 1163 - protein, 7 aa, Artificial Sequence
  Description of Artificial Sequence: Synthetic peptide
SSGSGGG

SEQ ID NO: 1164 - protein, 7 aa, Artificial Sequence
  Description of Artificial Sequence: Synthetic peptide
SSGGSGG

SEQ ID NO: 1165 - protein, 7 aa, Artificial Sequence
  Description of Artificial Sequence: Synthetic peptide
SSGGGSG

SEQ ID NO: 1166 - protein, 7 aa, Artificial Sequence
  Description of Artificial Sequence: Synthetic peptide
SSGGGGS

SEQ ID NO: 1167 - protein, 7 aa, Artificial Sequence
  Description of Artificial Sequence: Synthetic peptide
GSSSGGG

SEQ ID NO: 1168 - protein, 7 aa, Artificial Sequence
  Description of Artificial Sequence: Synthetic peptide
GSSGSGG

SEQ ID NO: 1169 - protein, 7 aa, Artificial Sequence
  Description of Artificial Sequence: Synthetic peptide
GSSGGSG

SEQ ID NO: 1170 - protein, 7 aa, Artificial Sequence
  Description of Artificial Sequence: Synthetic peptide
GSSGGGS

SEQ ID NO: 1171 - protein, 7 aa, Artificial Sequence
  Description of Artificial Sequence: Synthetic peptide
GSGSSGG

SEQ ID NO: 1172 - protein, 7 aa, Artificial Sequence
  Description of Artificial Sequence: Synthetic peptide
GSGGSSG

SEQ ID NO: 1173 - protein, 7 aa, Artificial Sequence
  Description of Artificial Sequence: Synthetic peptide
GSGGGSS

SEQ ID NO: 1174 - protein, 7 aa, Artificial Sequence
  Description of Artificial Sequence: Synthetic peptide
GSGSGSG

SEQ ID NO: 1175 - protein, 7 aa, Artificial Sequence
  Description of Artificial Sequence: Synthetic peptide
GSGSGGS

SEQ ID NO: 1176 - protein, 7 aa, Artificial Sequence
  Description of Artificial Sequence: Synthetic peptide
GSGGSGS

SEQ ID NO: 1177 - protein, 7 aa, Artificial Sequence
  Description of Artificial Sequence: Synthetic peptide
GGSSSGG

SEQ ID NO: 1178 - protein, 7 aa, Artificial Sequence
  Description of Artificial Sequence: Synthetic peptide
GGSSGSG

SEQ ID NO: 1179 - protein, 7 aa, Artificial Sequence
  Description of Artificial Sequence: Synthetic peptide
GGSSGGS

SEQ ID NO: 1180 - protein, 7 aa, Artificial Sequence
  Description of Artificial Sequence: Synthetic peptide
GGSGSSG

SEQ ID NO: 1181 - protein, 7 aa, Artificial Sequence
  Description of Artificial Sequence: Synthetic peptide
GGSGSGS

SEQ ID NO: 1182 - protein, 7 aa, Artificial Sequence
  Description of Artificial Sequence: Synthetic peptide
GGSGGSS

SEQ ID NO: 1183 - protein, 7 aa, Artificial Sequence
  Description of Artificial Sequence: Synthetic peptide
GGGSSSG

SEQ ID NO: 1184 - protein, 7 aa, Artificial Sequence
  Description of Artificial Sequence: Synthetic peptide
GGGSSGS

SEQ ID NO: 1185 - protein, 7 aa, Artificial Sequence
  Description of Artificial Sequence: Synthetic peptide
GGGSGSS

SEQ ID NO: 1186 - protein, 7 aa, Artificial Sequence
  Description of Artificial Sequence: Synthetic peptide
GGGGGSS

SEQ ID NO: 1187 - protein, 7 aa, Artificial Sequence
  Description of Artificial Sequence: Synthetic peptide
SSGGGGG

SEQ ID NO: 1188 - protein, 7 aa, Artificial Sequence
  Description of Artificial Sequence: Synthetic peptide
SGSGGGG

SEQ ID NO: 1189 - protein, 7 aa, Artificial Sequence
  Description of Artificial Sequence: Synthetic peptide
SGGSGGG

SEQ ID NO: 1190 - protein, 7 aa, Artificial Sequence
  Description of Artificial Sequence: Synthetic peptide
SGGGSGG

SEQ ID NO: 1191 - protein, 7 aa, Artificial Sequence
  Description of Artificial Sequence: Synthetic peptide
SGGGGSG

SEQ ID NO: 1192 - protein, 7 aa, Artificial Sequence
  Description of Artificial Sequence: Synthetic peptide
SGGGGGS

SEQ ID NO: 1193 - protein, 7 aa, Artificial Sequence
  Description of Artificial Sequence: Synthetic peptide
GSSGGGG

SEQ ID NO: 1194 - protein, 7 aa, Artificial Sequence
  Description of Artificial Sequence: Synthetic peptide
GSGSGGG

SEQ ID NO: 1195 - protein, 7 aa, Artificial Sequence
  Description of Artificial Sequence: Synthetic peptide
GSGGSGG

SEQ ID NO: 1196 - protein, 7 aa, Artificial Sequence
  Description of Artificial Sequence: Synthetic peptide
GSGGGSG

SEQ ID NO: 1197 - protein, 7 aa, Artificial Sequence
  Description of Artificial Sequence: Synthetic peptide
GSGGGGS

SEQ ID NO: 1198 - protein, 7 aa, Artificial Sequence
  Description of Artificial Sequence: Synthetic peptide
GGSSGGG

SEQ ID NO: 1199 - protein, 7 aa, Artificial Sequence
  Description of Artificial Sequence: Synthetic peptide
GGSGSGG

SEQ ID NO: 1200 - protein, 7 aa, Artificial Sequence
  Description of Artificial Sequence: Synthetic peptide
GGSGGSG

SEQ ID NO: 1201 - protein, 7 aa, Artificial Sequence
  Description of Artificial Sequence: Synthetic peptide
GGSGGGS

SEQ ID NO: 1202 - protein, 7 aa, Artificial Sequence
  Description of Artificial Sequence: Synthetic peptide
GGGSSGG

SEQ ID NO: 1203 - protein, 7 aa, Artificial Sequence
  Description of Artificial Sequence: Synthetic peptide
GGGSGSG

SEQ ID NO: 1204 - protein, 7 aa, Artificial Sequence
  Description of Artificial Sequence: Synthetic peptide
GGGSGGS

SEQ ID NO: 1205 - protein, 7 aa, Artificial Sequence
  Description of Artificial Sequence: Synthetic peptide
GGGGSSG

SEQ ID NO: 1206 - protein, 7 aa, Artificial Sequence
  Description of Artificial Sequence: Synthetic peptide
GGGGSGS

SEQ ID NO: 1207 - protein, 7 aa, Artificial Sequence
  Description of Artificial Sequence: Synthetic peptide
GGGGGGS

SEQ ID NO: 1208 - protein, 7 aa, Artificial Sequence
  Description of Artificial Sequence: Synthetic peptide
SGGGGGG

SEQ ID NO: 1209 - protein, 7 aa, Artificial Sequence
  Description of Artificial Sequence: Synthetic peptide
GSGGGGG

SEQ ID NO: 1210 - protein, 7 aa, Artificial Sequence
  Description of Artificial Sequence: Synthetic peptide
GGSGGGG

SEQ ID NO: 1211 - protein, 7 aa, Artificial Sequence
  Description of Artificial Sequence: Synthetic peptide
GGGSGGG

SEQ ID NO: 1212 - protein, 7 aa, Artificial Sequence
  Description of Artificial Sequence: Synthetic peptide
GGGGSGG

SEQ ID NO: 1213 - protein, 7 aa, Artificial Sequence
  Description of Artificial Sequence: Synthetic peptide
GGGGGSG

SEQ ID NO: 1214 - protein, 4 aa, Artificial Sequence
  Description of Artificial Sequence: Synthetic peptide
GGGQ

SEQ ID NO: 1215 - protein, 4 aa, Artificial Sequence
  Description of Artificial Sequence: Synthetic peptide
QGGG

SEQ ID NO: 1216 - protein, 4 aa, Artificial Sequence
  Description of Artificial Sequence: Synthetic peptide
GQGG

SEQ ID NO: 1217 - protein, 4 aa, Artificial Sequence
  Description of Artificial Sequence: Synthetic peptide
GGQG

SEQ ID NO: 1218 - protein, 5 aa, Artificial Sequence
  Description of Artificial Sequence: Synthetic peptide
GGGGQ

SEQ ID NO: 1219 - protein, 5 aa, Artificial Sequence
  Description of Artificial Sequence: Synthetic peptide
QGGGG

SEQ ID NO: 1220 - protein, 5 aa, Artificial Sequence
  Description of Artificial Sequence: Synthetic peptide
GQGGG

SEQ ID NO: 1221 - protein, 5 aa, Artificial Sequence
  Description of Artificial Sequence: Synthetic peptide
GGQGG

SEQ ID NO: 1222 - protein, 5 aa, Artificial Sequence
  Description of Artificial Sequence: Synthetic peptide
GGGQG

SEQ ID NO: 1223 - protein, 5 aa, Artificial Sequence
  Description of Artificial Sequence: Synthetic peptide
GGGQQ

SEQ ID NO: 1224 - protein, 5 aa, Artificial Sequence
  Description of Artificial Sequence: Synthetic peptide
QQGGG

SEQ ID NO: 1225 - protein, 5 aa, Artificial Sequence
  Description of Artificial Sequence: Synthetic peptide
QGQGG

SEQ ID NO: 1226 - protein, 5 aa, Artificial Sequence
  Description of Artificial Sequence: Synthetic peptide
QGGQG

SEQ ID NO: 1227 - protein, 5 aa, Artificial Sequence
  Description of Artificial Sequence: Synthetic peptide
QGGGQ

SEQ ID NO: 1228 - protein, 5 aa, Artificial Sequence
  Description of Artificial Sequence: Synthetic peptide
GQQGG

SEQ ID NO: 1229 - protein, 5 aa, Artificial Sequence
  Description of Artificial Sequence: Synthetic peptide
GQGQG

SEQ ID NO: 1230 - protein, 5 aa, Artificial Sequence
  Description of Artificial Sequence: Synthetic peptide
GQGGQ

SEQ ID NO: 1231 - protein, 5 aa, Artificial Sequence
  Description of Artificial Sequence: Synthetic peptide
GGQQG

SEQ ID NO: 1232 - protein, 5 aa, Artificial Sequence
  Description of Artificial Sequence: Synthetic peptide
GGQGQ

SEQ ID NO: 1233 - protein, 6 aa, Artificial Sequence
  Description of Artificial Sequence: Synthetic peptide
GGGGGQ

SEQ ID NO: 1234 - protein, 6 aa, Artificial Sequence
  Description of Artificial Sequence: Synthetic peptide
QGGGGG

SEQ ID NO: 1235 - protein, 6 aa, Artificial Sequence
  Description of Artificial Sequence: Synthetic peptide
GQGGGG

SEQ ID NO: 1236 - protein, 6 aa, Artificial Sequence
  Description of Artificial Sequence: Synthetic peptide
GGQGGG

SEQ ID NO: 1237 - protein, 6 aa, Artificial Sequence
  Description of Artificial Sequence: Synthetic peptide
GGGQGG

SEQ ID NO: 1238 - protein, 6 aa, Artificial Sequence
  Description of Artificial Sequence: Synthetic peptide
GGGGQG

SEQ ID NO: 1239 - protein, 6 aa, Artificial Sequence
  Description of Artificial Sequence: Synthetic peptide
GGGGQQ

SEQ ID NO: 1240 - protein, 6 aa, Artificial Sequence
  Description of Artificial Sequence: Synthetic peptide
QQGGGG

SEQ ID NO: 1241 - protein, 6 aa, Artificial Sequence
  Description of Artificial Sequence: Synthetic peptide
QGQGGG

SEQ ID NO: 1242 - protein, 6 aa, Artificial Sequence
  Description of Artificial Sequence: Synthetic peptide
QGGQGG

SEQ ID NO: 1243 - protein, 6 aa, Artificial Sequence
  Description of Artificial Sequence: Synthetic peptide
QGGGQG

SEQ ID NO: 1244 - protein, 6 aa, Artificial Sequence
  Description of Artificial Sequence: Synthetic peptide
QGGGGQ

SEQ ID NO: 1245 - protein, 6 aa, Artificial Sequence
  Description of Artificial Sequence: Synthetic peptide
GQQGGG

SEQ ID NO: 1246 - protein, 6 aa, Artificial Sequence
  Description of Artificial Sequence: Synthetic peptide
GQGQGG

SEQ ID NO: 1247 - protein, 6 aa, Artificial Sequence
  Description of Artificial Sequence: Synthetic peptide
GQGGQG

SEQ ID NO: 1248 - protein, 6 aa, Artificial Sequence
  Description of Artificial Sequence: Synthetic peptide
GQGGGQ

SEQ ID NO: 1249 - protein, 6 aa, Artificial Sequence
  Description of Artificial Sequence: Synthetic peptide
GGQQGG

SEQ ID NO: 1250 - protein, 6 aa, Artificial Sequence
  Description of Artificial Sequence: Synthetic peptide
GGQGQG

SEQ ID NO: 1251 - protein, 6 aa, Artificial Sequence
  Description of Artificial Sequence: Synthetic peptide
GGQGGQ

SEQ ID NO: 1252 - protein, 6 aa, Artificial Sequence
  Description of Artificial Sequence: Synthetic peptide
GGGQQG

SEQ ID NO: 1253 - protein, 6 aa, Artificial Sequence
  Description of Artificial Sequence: Synthetic peptide
GGGQGQ

SEQ ID NO: 1254 - protein, 7 aa, Artificial Sequence
  Description of Artificial Sequence: Synthetic peptide
GGGGQQQ

SEQ ID NO: 1255 - protein, 7 aa, Artificial Sequence
  Description of Artificial Sequence: Synthetic peptide
QQQGGGG

SEQ ID NO: 1256 - protein, 7 aa, Artificial Sequence
  Description of Artificial Sequence: Synthetic peptide
QGQQGGG

SEQ ID NO: 1257 - protein, 7 aa, Artificial Sequence
  Description of Artificial Sequence: Synthetic peptide
QGQGQGG

SEQ ID NO: 1258 - protein, 7 aa, Artificial Sequence
  Description of Artificial Sequence: Synthetic peptide
QGQGGQG

SEQ ID NO: 1259 - protein, 7 aa, Artificial Sequence
  Description of Artificial Sequence: Synthetic peptide
QGQGGGQ

SEQ ID NO: 1260 - protein, 7 aa, Artificial Sequence
  Description of Artificial Sequence: Synthetic peptide
QGGQQGG

SEQ ID NO: 1261 - protein, 7 aa, Artificial Sequence
  Description of Artificial Sequence: Synthetic peptide
QGGQGQG

SEQ ID NO: 1262 - protein, 7 aa, Artificial Sequence
  Description of Artificial Sequence: Synthetic peptide
QGGQGGQ

SEQ ID NO: 1263 - protein, 7 aa, Artificial Sequence
  Description of Artificial Sequence: Synthetic peptide
QGGGQGQ

SEQ ID NO: 1264 - protein, 7 aa, Artificial Sequence
  Description of Artificial Sequence: Synthetic peptide
QGGGQQG

SEQ ID NO: 1265 - protein, 7 aa, Artificial Sequence
  Description of Artificial Sequence: Synthetic peptide
QGGGGQQ

SEQ ID NO: 1266 - protein, 7 aa, Artificial Sequence
  Description of Artificial Sequence: Synthetic peptide
QQGQGGG

SEQ ID NO: 1267 - protein, 7 aa, Artificial Sequence
  Description of Artificial Sequence: Synthetic peptide
QQGGQGG

SEQ ID NO: 1268 - protein, 7 aa, Artificial Sequence
  Description of Artificial Sequence: Synthetic peptide
QQGGGQG

SEQ ID NO: 1269 - protein, 7 aa, Artificial Sequence
  Description of Artificial Sequence: Synthetic peptide
QQGGGGQ

SEQ ID NO: 1270 - protein, 7 aa, Artificial Sequence
  Description of Artificial Sequence: Synthetic peptide
GQQQGGG

SEQ ID NO: 1271 - protein, 7 aa, Artificial Sequence
  Description of Artificial Sequence: Synthetic peptide
GQQGQGG

SEQ ID NO: 1272 - protein, 7 aa, Artificial Sequence
  Description of Artificial Sequence: Synthetic peptide
GQQGGQG

SEQ ID NO: 1273 - protein, 7 aa, Artificial Sequence
  Description of Artificial Sequence: Synthetic peptide
GQQGGGQ

SEQ ID NO: 1274 - protein, 7 aa, Artificial Sequence
  Description of Artificial Sequence: Synthetic peptide
GQGQQGG

SEQ ID NO: 1275 - protein, 7 aa, Artificial Sequence
  Description of Artificial Sequence: Synthetic peptide
GQGGQQG

SEQ ID NO: 1276 - protein, 7 aa, Artificial Sequence
  Description of Artificial Sequence: Synthetic peptide
GQGGGQQ

SEQ ID NO: 1277 - protein, 7 aa, Artificial Sequence
  Description of Artificial Sequence: Synthetic peptide
GQGQGQG

SEQ ID NO: 1278 - protein, 7 aa, Artificial Sequence
  Description of Artificial Sequence: Synthetic peptide
GQGQGGQ

SEQ ID NO: 1279 - protein, 7 aa, Artificial Sequence
  Description of Artificial Sequence: Synthetic peptide
GQGGQGQ

SEQ ID NO: 1280 - protein, 7 aa, Artificial Sequence
  Description of Artificial Sequence: Synthetic peptide
GGQQQGG

SEQ ID NO: 1281 - protein, 7 aa, Artificial Sequence
  Description of Artificial Sequence: Synthetic peptide
GGQQGQG

SEQ ID NO: 1282 - protein, 7 aa, Artificial Sequence
  Description of Artificial Sequence: Synthetic peptide
GGQQGGQ

SEQ ID NO: 1283 - protein, 7 aa, Artificial Sequence
  Description of Artificial Sequence: Synthetic peptide
GGQGQQG

SEQ ID NO: 1284 - protein, 7 aa, Artificial Sequence
  Description of Artificial Sequence: Synthetic peptide
GGQGQGQ

SEQ ID NO: 1285 - protein, 7 aa, Artificial Sequence
  Description of Artificial Sequence: Synthetic peptide
GGQGGQQ

SEQ ID NO: 1286 - protein, 7 aa, Artificial Sequence
  Description of Artificial Sequence: Synthetic peptide
GGGQQQG

SEQ ID NO: 1287 - protein, 7 aa, Artificial Sequence
  Description of Artificial Sequence: Synthetic peptide
GGGQQGQ

SEQ ID NO: 1288 - protein, 7 aa, Artificial Sequence
  Description of Artificial Sequence: Synthetic peptide
GGGQGQQ

SEQ ID NO: 1289 - protein, 7 aa, Artificial Sequence
  Description of Artificial Sequence: Synthetic peptide
GGGGGQQ

SEQ ID NO: 1290 - protein, 7 aa, Artificial Sequence
  Description of Artificial Sequence: Synthetic peptide
QQGGGGG

SEQ ID NO: 1291 - protein, 7 aa, Artificial Sequence
  Description of Artificial Sequence: Synthetic peptide
QGQGGGG

SEQ ID NO: 1292 - protein, 7 aa, Artificial Sequence
  Description of Artificial Sequence: Synthetic peptide
QGGQGGG

SEQ ID NO: 1293 - protein, 7 aa, Artificial Sequence
  Description of Artificial Sequence: Synthetic peptide
QGGGQGG

SEQ ID NO: 1294 - protein, 7 aa, Artificial Sequence
  Description of Artificial Sequence: Synthetic peptide
QGGGGQG

SEQ ID NO: 1295 - protein, 7 aa, Artificial Sequence
  Description of Artificial Sequence: Synthetic peptide
QGGGGGQ

SEQ ID NO: 1296 - protein, 7 aa, Artificial Sequence
  Description of Artificial Sequence: Synthetic peptide
GQQGGGG

SEQ ID NO: 1297 - protein, 7 aa, Artificial Sequence
  Description of Artificial Sequence: Synthetic peptide
GQGQGGG

SEQ ID NO: 1298 - protein, 7 aa, Artificial Sequence
  Description of Artificial Sequence: Synthetic peptide
GQGGQGG

SEQ ID NO: 1299 - protein, 7 aa, Artificial Sequence
  Description of Artificial Sequence: Synthetic peptide
GQGGGQG

SEQ ID NO: 1300 - protein, 7 aa, Artificial Sequence
  Description of Artificial Sequence: Synthetic peptide
GQGGGGQ

SEQ ID NO: 1301 - protein, 7 aa, Artificial Sequence
  Description of Artificial Sequence: Synthetic peptide
GGQQGGG

SEQ ID NO: 1302 - protein, 7 aa, Artificial Sequence
  Description of Artificial Sequence: Synthetic peptide
GGQGQGG

SEQ ID NO: 1303 - protein, 7 aa, Artificial Sequence
  Description of Artificial Sequence: Synthetic peptide
GGQGGQG

SEQ ID NO: 1304 - protein, 7 aa, Artificial Sequence
  Description of Artificial Sequence: Synthetic peptide
GGQGGGQ

SEQ ID NO: 1305 - protein, 7 aa, Artificial Sequence
  Description of Artificial Sequence: Synthetic peptide
GGGQQGG

SEQ ID NO: 1306 - protein, 7 aa, Artificial Sequence
  Description of Artificial Sequence: Synthetic peptide
GGGQGQG

SEQ ID NO: 1307 - protein, 7 aa, Artificial Sequence
  Description of Artificial Sequence: Synthetic peptide
GGGQGGQ

SEQ ID NO: 1308 - protein, 7 aa, Artificial Sequence
  Description of Artificial Sequence: Synthetic peptide
GGGGQQG

SEQ ID NO: 1309 - protein, 7 aa, Artificial Sequence
  Description of Artificial Sequence: Synthetic peptide
GGGGQGQ

SEQ ID NO: 1310 - protein, 7 aa, Artificial Sequence
  Description of Artificial Sequence: Synthetic peptide
GGGGGGQ

SEQ ID NO: 1311 - protein, 7 aa, Artificial Sequence
  Description of Artificial Sequence: Synthetic peptide
QGGGGGG

SEQ ID NO: 1312 - protein, 7 aa, Artificial Sequence
  Description of Artificial Sequence: Synthetic peptide
GQGGGGG

SEQ ID NO: 1313 - protein, 7 aa, Artificial Sequence
  Description of Artificial Sequence: Synthetic peptide
GGQGGGG

SEQ ID NO: 1314 - protein, 7 aa, Artificial Sequence
  Description of Artificial Sequence: Synthetic peptide
GGGQGGG

SEQ ID NO: 1315 - protein, 7 aa, Artificial Sequence
  Description of Artificial Sequence: Synthetic peptide
GGGGQGG

SEQ ID NO: 1316 - protein, 7 aa, Artificial Sequence
  Description of Artificial Sequence: Synthetic peptide
GGGGGQG

SEQ ID NO: 1317 - protein, 4 aa, Artificial Sequence
  Description of Artificial Sequence: Synthetic peptide
GGGE

SEQ ID NO: 1318 - protein, 4 aa, Artificial Sequence
  Description of Artificial Sequence: Synthetic peptide
EGGG

SEQ ID NO: 1319 - protein, 4 aa, Artificial Sequence
  Description of Artificial Sequence: Synthetic peptide
GEGG

SEQ ID NO: 1320 - protein, 4 aa, Artificial Sequence
  Description of Artificial Sequence: Synthetic peptide
GGEG

SEQ ID NO: 1321 - protein, 5 aa, Artificial Sequence
  Description of Artificial Sequence: Synthetic peptide
GGGGE

SEQ ID NO: 1322 - protein, 5 aa, Artificial Sequence
  Description of Artificial Sequence: Synthetic peptide
EGGGG

SEQ ID NO: 1323 - protein, 5 aa, Artificial Sequence
  Description of Artificial Sequence: Synthetic peptide
GEGGG

SEQ ID NO: 1324 - protein, 5 aa, Artificial Sequence
  Description of Artificial Sequence: Synthetic peptide
GGEGG

SEQ ID NO: 1325 - protein, 5 aa, Artificial Sequence
  Description of Artificial Sequence: Synthetic peptide
GGGEG

SEQ ID NO: 1326 - protein, 5 aa, Artificial Sequence
  Description of Artificial Sequence: Synthetic peptide
GGGEE

SEQ ID NO: 1327 - protein, 5 aa, Artificial Sequence
  Description of Artificial Sequence: Synthetic peptide
EEGGG

SEQ ID NO: 1328 - protein, 5 aa, Artificial Sequence
  Description of Artificial Sequence: Synthetic peptide
EGEGG

SEQ ID NO: 1329 - protein, 5 aa, Artificial Sequence
  Description of Artificial Sequence: Synthetic peptide
EGGEG

SEQ ID NO: 1330 - protein, 5 aa, Artificial Sequence
  Description of Artificial Sequence: Synthetic peptide
EGGGE

SEQ ID NO: 1331 - protein, 5 aa, Artificial Sequence
  Description of Artificial Sequence: Synthetic peptide
GEEGG

SEQ ID NO: 1332 - protein, 5 aa, Artificial Sequence
  Description of Artificial Sequence: Synthetic peptide
GEGEG

SEQ ID NO: 1333 - protein, 5 aa, Artificial Sequence
  Description of Artificial Sequence: Synthetic peptide
GEGGE

SEQ ID NO: 1334 - protein, 5 aa, Artificial Sequence
  Description of Artificial Sequence: Synthetic peptide
GGEEG

SEQ ID NO: 1335 - protein, 5 aa, Artificial Sequence
  Description of Artificial Sequence: Synthetic peptide
GGEGE

SEQ ID NO: 1336 - protein, 6 aa, Artificial Sequence
  Description of Artificial Sequence: Synthetic peptide
GGGGGE

SEQ ID NO: 1337 - protein, 6 aa, Artificial Sequence
  Description of Artificial Sequence: Synthetic peptide
EGGGGG

SEQ ID NO: 1338 - protein, 6 aa, Artificial Sequence
  Description of Artificial Sequence: Synthetic peptide
GEGGGG

SEQ ID NO: 1339 - protein, 6 aa, Artificial Sequence
  Description of Artificial Sequence: Synthetic peptide
GGEGGG

SEQ ID NO: 1340 - protein, 6 aa, Artificial Sequence
  Description of Artificial Sequence: Synthetic peptide
GGGEGG

SEQ ID NO: 1341 - protein, 6 aa, Artificial Sequence
  Description of Artificial Sequence: Synthetic peptide
GGGGEG

SEQ ID NO: 1342 - protein, 6 aa, Artificial Sequence
  Description of Artificial Sequence: Synthetic peptide
GGGGEE

SEQ ID NO: 1343 - protein, 6 aa, Artificial Sequence
  Description of Artificial Sequence: Synthetic peptide
EEGGGG

SEQ ID NO: 1344 - protein, 6 aa, Artificial Sequence
  Description of Artificial Sequence: Synthetic peptide
EGEGGG

SEQ ID NO: 1345 - protein, 6 aa, Artificial Sequence
  Description of Artificial Sequence: Synthetic peptide
EGGEGG

SEQ ID NO: 1346 - protein, 6 aa, Artificial Sequence
  Description of Artificial Sequence: Synthetic peptide
EGGGEG

SEQ ID NO: 1347 - protein, 6 aa, Artificial Sequence
  Description of Artificial Sequence: Synthetic peptide
EGGGGE

SEQ ID NO: 1348 - protein, 6 aa, Artificial Sequence
  Description of Artificial Sequence: Synthetic peptide
GEEGGG

SEQ ID NO: 1349 - protein, 6 aa, Artificial Sequence
  Description of Artificial Sequence: Synthetic peptide
GEGEGG

SEQ ID NO: 1350 - protein, 6 aa, Artificial Sequence
  Description of Artificial Sequence: Synthetic peptide
GEGGEG

SEQ ID NO: 1351 - protein, 6 aa, Artificial Sequence
  Description of Artificial Sequence: Synthetic peptide
GEGGGE

SEQ ID NO: 1352 - protein, 6 aa, Artificial Sequence
  Description of Artificial Sequence: Synthetic peptide
GGEEGG

SEQ ID NO: 1353 - protein, 6 aa, Artificial Sequence
  Description of Artificial Sequence: Synthetic peptide
GGEGEG

SEQ ID NO: 1354 - protein, 6 aa, Artificial Sequence
  Description of Artificial Sequence: Synthetic peptide
GGEGGE

SEQ ID NO: 1355 - protein, 6 aa, Artificial Sequence
  Description of Artificial Sequence: Synthetic peptide
GGGEEG

SEQ ID NO: 1356 - protein, 6 aa, Artificial Sequence
  Description of Artificial Sequence: Synthetic peptide
GGGEGE

SEQ ID NO: 1357 - protein, 7 aa, Artificial Sequence
  Description of Artificial Sequence: Synthetic peptide
GGGGEEE

SEQ ID NO: 1358 - protein, 7 aa, Artificial Sequence
  Description of Artificial Sequence: Synthetic peptide
EEEGGGG

SEQ ID NO: 1359 - protein, 7 aa, Artificial Sequence
  Description of Artificial Sequence: Synthetic peptide
EGEEGGG

SEQ ID NO: 1360 - protein, 7 aa, Artificial Sequence
  Description of Artificial Sequence: Synthetic peptide
EGEGEGG

SEQ ID NO: 1361 - protein, 7 aa, Artificial Sequence
  Description of Artificial Sequence: Synthetic peptide
EGEGGEG

SEQ ID NO: 1362 - protein, 7 aa, Artificial Sequence
  Description of Artificial Sequence: Synthetic peptide
EGEGGGE

SEQ ID NO: 1363 - protein, 7 aa, Artificial Sequence
  Description of Artificial Sequence: Synthetic peptide
EGGEEGG

SEQ ID NO: 1364 - protein, 7 aa, Artificial Sequence
  Description of Artificial Sequence: Synthetic peptide
EGGEGEG

SEQ ID NO: 1365 - protein, 7 aa, Artificial Sequence
  Description of Artificial Sequence: Synthetic peptide
EGGEGGE

SEQ ID NO: 1366 - protein, 7 aa, Artificial Sequence
  Description of Artificial Sequence: Synthetic peptide
EGGGEGE

SEQ ID NO: 1367 - protein, 7 aa, Artificial Sequence
  Description of Artificial Sequence: Synthetic peptide
EGGGEEG

SEQ ID NO: 1368 - protein, 7 aa, Artificial Sequence
  Description of Artificial Sequence: Synthetic peptide
EGGGGEE

SEQ ID NO: 1369 - protein, 7 aa, Artificial Sequence
  Description of Artificial Sequence: Synthetic peptide
EEGEGGG

SEQ ID NO: 1370 - protein, 7 aa, Artificial Sequence
  Description of Artificial Sequence: Synthetic peptide
EEGGEGG

SEQ ID NO: 1371 - protein, 7 aa, Artificial Sequence
  Description of Artificial Sequence: Synthetic peptide
EEGGGEG

SEQ ID NO: 1372 - protein, 7 aa, Artificial Sequence
  Description of Artificial Sequence: Synthetic peptide
EEGGGGE

SEQ ID NO: 1373 - protein, 7 aa, Artificial Sequence
  Description of Artificial Sequence: Synthetic peptide
GEEEGGG

SEQ ID NO: 1374 - protein, 7 aa, Artificial Sequence
  Description of Artificial Sequence: Synthetic peptide
GEEGEGG

SEQ ID NO: 1375 - protein, 7 aa, Artificial Sequence
  Description of Artificial Sequence: Synthetic peptide
GEEGGEG

SEQ ID NO: 1376 - protein, 7 aa, Artificial Sequence
  Description of Artificial Sequence: Synthetic peptide
GEEGGGE

SEQ ID NO: 1377 - protein, 7 aa, Artificial Sequence
  Description of Artificial Sequence: Synthetic peptide
GEGEEGG

SEQ ID NO: 1378 - protein, 7 aa, Artificial Sequence
  Description of Artificial Sequence: Synthetic peptide
GEGGEEG

SEQ ID NO: 1379 - protein, 7 aa, Artificial Sequence
  Description of Artificial Sequence: Synthetic peptide
GEGGGEE

SEQ ID NO: 1380 - protein, 7 aa, Artificial Sequence
  Description of Artificial Sequence: Synthetic peptide
GEGEGEG

SEQ ID NO: 1381 - protein, 7 aa, Artificial Sequence
  Description of Artificial Sequence: Synthetic peptide
GEGEGGE

SEQ ID NO: 1382 - protein, 7 aa, Artificial Sequence
  Description of Artificial Sequence: Synthetic peptide
GEGGEGE

SEQ ID NO: 1383 - protein, 7 aa, Artificial Sequence
  Description of Artificial Sequence: Synthetic peptide
GGEEEGG

SEQ ID NO: 1384 - protein, 7 aa, Artificial Sequence
  Description of Artificial Sequence: Synthetic peptide
GGEEGEG

SEQ ID NO: 1385 - protein, 7 aa, Artificial Sequence
  Description of Artificial Sequence: Synthetic peptide
GGEEGGE

SEQ ID NO: 1386 - protein, 7 aa, Artificial Sequence
  Description of Artificial Sequence: Synthetic peptide
GGEGEEG

SEQ ID NO: 1387 - protein, 7 aa, Artificial Sequence
  Description of Artificial Sequence: Synthetic peptide
GGEGEGE

SEQ ID NO: 1388 - protein, 7 aa, Artificial Sequence
  Description of Artificial Sequence: Synthetic peptide
GGEGGEE

SEQ ID NO: 1389 - protein, 7 aa, Artificial Sequence
  Description of Artificial Sequence: Synthetic peptide
GGGEEEG

SEQ ID NO: 1390 - protein, 7 aa, Artificial Sequence
  Description of Artificial Sequence: Synthetic peptide
GGGEEGE

SEQ ID NO: 1391 - protein, 7 aa, Artificial Sequence
  Description of Artificial Sequence: Synthetic peptide
GGGEGEE

SEQ ID NO: 1392 - protein, 7 aa, Artificial Sequence
  Description of Artificial Sequence: Synthetic peptide
GGGGGEE

SEQ ID NO: 1393 - protein, 7 aa, Artificial Sequence
  Description of Artificial Sequence: Synthetic peptide
EEGGGGG

SEQ ID NO: 1394 - protein, 7 aa, Artificial Sequence
  Description of Artificial Sequence: Synthetic peptide
EGEGGGG

SEQ ID NO: 1395 - protein, 7 aa, Artificial Sequence
  Description of Artificial Sequence: Synthetic peptide
EGGEGGG

SEQ ID NO: 1396 - protein, 7 aa, Artificial Sequence
  Description of Artificial Sequence: Synthetic peptide
EGGGEGG

SEQ ID NO: 1397 - protein, 7 aa, Artificial Sequence
  Description of Artificial Sequence: Synthetic peptide
EGGGGEG

SEQ ID NO: 1398 - protein, 7 aa, Artificial Sequence
  Description of Artificial Sequence: Synthetic peptide
EGGGGGE

SEQ ID NO: 1399 - protein, 7 aa, Artificial Sequence
  Description of Artificial Sequence: Synthetic peptide
GEEGGGG

SEQ ID NO: 1400 - protein, 7 aa, Artificial Sequence
  Description of Artificial Sequence: Synthetic peptide
GEGEGGG

SEQ ID NO: 1401 - protein, 7 aa, Artificial Sequence
  Description of Artificial Sequence: Synthetic peptide
GEGGEGG

SEQ ID NO: 1402 - protein, 7 aa, Artificial Sequence
  Description of Artificial Sequence: Synthetic peptide
GEGGGEG

SEQ ID NO: 1403 - protein, 7 aa, Artificial Sequence
  Description of Artificial Sequence: Synthetic peptide
GEGGGGE

SEQ ID NO: 1404 - protein, 7 aa, Artificial Sequence
  Description of Artificial Sequence: Synthetic peptide
GGEEGGG

SEQ ID NO: 1405 - protein, 7 aa, Artificial Sequence
  Description of Artificial Sequence: Synthetic peptide
GGEGEGG

SEQ ID NO: 1406 - protein, 7 aa, Artificial Sequence
  Description of Artificial Sequence: Synthetic peptide
GGEGGEG

SEQ ID NO: 1407 - protein, 7 aa, Artificial Sequence
  Description of Artificial Sequence: Synthetic peptide
GGEGGGE

SEQ ID NO: 1408 - protein, 7 aa, Artificial Sequence
  Description of Artificial Sequence: Synthetic peptide
GGGEEGG

SEQ ID NO: 1409 - protein, 7 aa, Artificial Sequence
  Description of Artificial Sequence: Synthetic peptide
GGGEGEG

SEQ ID NO: 1410 - protein, 7 aa, Artificial Sequence
  Description of Artificial Sequence: Synthetic peptide
GGGEGGE

SEQ ID NO: 1411 - protein, 7 aa, Artificial Sequence
  Description of Artificial Sequence: Synthetic peptide
GGGGEEG

SEQ ID NO: 1412 - protein, 7 aa, Artificial Sequence
  Description of Artificial Sequence: Synthetic peptide
GGGGEGE

SEQ ID NO: 1413 - protein, 7 aa, Artificial Sequence
  Description of Artificial Sequence: Synthetic peptide
GGGGGGE

SEQ ID NO: 1414 - protein, 7 aa, Artificial Sequence
  Description of Artificial Sequence: Synthetic peptide
EGGGGGG

SEQ ID NO: 1415 - protein, 7 aa, Artificial Sequence
  Description of Artificial Sequence: Synthetic peptide
GEGGGGG

SEQ ID NO: 1416 - protein, 7 aa, Artificial Sequence
  Description of Artificial Sequence: Synthetic peptide
GGEGGGG

SEQ ID NO: 1417 - protein, 7 aa, Artificial Sequence
  Description of Artificial Sequence: Synthetic peptide
GGGEGGG

SEQ ID NO: 1418 - protein, 7 aa, Artificial Sequence
  Description of Artificial Sequence: Synthetic peptide
GGGGEGG

SEQ ID NO: 1419 - protein, 7 aa, Artificial Sequence
  Description of Artificial Sequence: Synthetic peptide
GGGGGEG

SEQ ID NO: 1420 - protein, 4 aa, Artificial Sequence
  Description of Artificial Sequence: Synthetic peptide
GGGH

SEQ ID NO: 1421 - protein, 4 aa, Artificial Sequence
  Description of Artificial Sequence: Synthetic peptide
HGGG

SEQ ID NO: 1422 - protein, 4 aa, Artificial Sequence
  Description of Artificial Sequence: Synthetic peptide
GHGG

SEQ ID NO: 1423 - protein, 4 aa, Artificial Sequence
  Description of Artificial Sequence: Synthetic peptide
GGHG

SEQ ID NO: 1424 - protein, 5 aa, Artificial Sequence
  Description of Artificial Sequence: Synthetic peptide
GGGGH

SEQ ID NO: 1425 - protein, 5 aa, Artificial Sequence
  Description of Artificial Sequence: Synthetic peptide
HGGGG

SEQ ID NO: 1426 - protein, 5 aa, Artificial Sequence
  Description of Artificial Sequence: Synthetic peptide
GHGGG

SEQ ID NO: 1427 - protein, 5 aa, Artificial Sequence
  Description of Artificial Sequence: Synthetic peptide
GGHGG

SEQ ID NO: 1428 - protein, 5 aa, Artificial Sequence
  Description of Artificial Sequence: Synthetic peptide
GGGHG

SEQ ID NO: 1429 - protein, 5 aa, Artificial Sequence
  Description of Artificial Sequence: Synthetic peptide
GGGHH

SEQ ID NO: 1430 - protein, 5 aa, Artificial Sequence
  Description of Artificial Sequence: Synthetic peptide
HHGGG

SEQ ID NO: 1431 - protein, 5 aa, Artificial Sequence
  Description of Artificial Sequence: Synthetic peptide
HGHGG

SEQ ID NO: 1432 - protein, 5 aa, Artificial Sequence
  Description of Artificial Sequence: Synthetic peptide
HGGHG

SEQ ID NO: 1433 - protein, 5 aa, Artificial Sequence
  Description of Artificial Sequence: Synthetic peptide
HGGGH

SEQ ID NO: 1434 - protein, 5 aa, Artificial Sequence
  Description of Artificial Sequence: Synthetic peptide
GHHGG

SEQ ID NO: 1435 - protein, 5 aa, Artificial Sequence
  Description of Artificial Sequence: Synthetic peptide
GHGHG

SEQ ID NO: 1436 - protein, 5 aa, Artificial Sequence
  Description of Artificial Sequence: Synthetic peptide
GHGGH

SEQ ID NO: 1437 - protein, 5 aa, Artificial Sequence
  Description of Artificial Sequence: Synthetic peptide
GGHHG

SEQ ID NO: 1438 - protein, 5 aa, Artificial Sequence
  Description of Artificial Sequence: Synthetic peptide
GGHGH

SEQ ID NO: 1439 - protein, 6 aa, Artificial Sequence
  Description of Artificial Sequence: Synthetic peptide
GGGGGH

SEQ ID NO: 1440 - protein, 6 aa, Artificial Sequence
  Description of Artificial Sequence: Synthetic peptide
HGGGGG

SEQ ID NO: 1441 - protein, 6 aa, Artificial Sequence
  Description of Artificial Sequence: Synthetic peptide
GHGGGG

SEQ ID NO: 1442 - protein, 6 aa, Artificial Sequence
  Description of Artificial Sequence: Synthetic peptide
GGHGGG

SEQ ID NO: 1443 - protein, 6 aa, Artificial Sequence
  Description of Artificial Sequence: Synthetic peptide
GGGHGG

SEQ ID NO: 1444 - protein, 6 aa, Artificial Sequence
  Description of Artificial Sequence: Synthetic peptide
GGGGHG

SEQ ID NO: 1445 - protein, 6 aa, Artificial Sequence
  Description of Artificial Sequence: Synthetic peptide
GGGGHH

SEQ ID NO: 1446 - protein, 6 aa, Artificial Sequence
  Description of Artificial Sequence: Synthetic peptide
HHGGGG

SEQ ID NO: 1447 - protein, 6 aa, Artificial Sequence
  Description of Artificial Sequence: Synthetic peptide
HGHGGG

SEQ ID NO: 1448 - protein, 6 aa, Artificial Sequence
  Description of Artificial Sequence: Synthetic peptide
HGGHGG

SEQ ID NO: 1449 - protein, 6 aa, Artificial Sequence
  Description of Artificial Sequence: Synthetic peptide
HGGGHG

SEQ ID NO: 1450 - protein, 6 aa, Artificial Sequence
  Description of Artificial Sequence: Synthetic peptide
HGGGGH

SEQ ID NO: 1451 - protein, 6 aa, Artificial Sequence
  Description of Artificial Sequence: Synthetic peptide
GHHGGG

SEQ ID NO: 1452 - protein, 6 aa, Artificial Sequence
  Description of Artificial Sequence: Synthetic peptide
GHGHGG

SEQ ID NO: 1453 - protein, 6 aa, Artificial Sequence
  Description of Artificial Sequence: Synthetic peptide
GHGGHG

SEQ ID NO: 1454 - protein, 6 aa, Artificial Sequence
  Description of Artificial Sequence: Synthetic peptide
GHGGGH

SEQ ID NO: 1455 - protein, 6 aa, Artificial Sequence
  Description of Artificial Sequence: Synthetic peptide
GGHHGG

SEQ ID NO: 1456 - protein, 6 aa, Artificial Sequence
  Description of Artificial Sequence: Synthetic peptide
GGHGHG

SEQ ID NO: 1457 - protein, 6 aa, Artificial Sequence
  Description of Artificial Sequence: Synthetic peptide
GGHGGH

SEQ ID NO: 1458 - protein, 6 aa, Artificial Sequence
  Description of Artificial Sequence: Synthetic peptide
GGGHHG

SEQ ID NO: 1459 - protein, 6 aa, Artificial Sequence
  Description of Artificial Sequence: Synthetic peptide
GGGHGH

SEQ ID NO: 1460 - protein, 7 aa, Artificial Sequence
  Description of Artificial Sequence: Synthetic peptide
GGGGHHH

SEQ ID NO: 1461 - protein, 7 aa, Artificial Sequence
  Description of Artificial Sequence: Synthetic peptide
HHHGGGG

SEQ ID NO: 1462 - protein, 7 aa, Artificial Sequence
  Description of Artificial Sequence: Synthetic peptide
HGHHGGG

SEQ ID NO: 1463 - protein, 7 aa, Artificial Sequence
  Description of Artificial Sequence: Synthetic peptide
HGHGHGG

SEQ ID NO: 1464 - protein, 7 aa, Artificial Sequence
  Description of Artificial Sequence: Synthetic peptide
HGHGGHG

SEQ ID NO: 1465 - protein, 7 aa, Artificial Sequence
  Description of Artificial Sequence: Synthetic peptide
HGHGGGH

SEQ ID NO: 1466 - protein, 7 aa, Artificial Sequence
  Description of Artificial Sequence: Synthetic peptide
HGGHHGG

SEQ ID NO: 1467 - protein, 7 aa, Artificial Sequence
  Description of Artificial Sequence: Synthetic peptide
HGGHGHG

SEQ ID NO: 1468 - protein, 7 aa, Artificial Sequence
  Description of Artificial Sequence: Synthetic peptide
HGGHGGH

SEQ ID NO: 1469 - protein, 7 aa, Artificial Sequence
  Description of Artificial Sequence: Synthetic peptide
HGGGHGH

SEQ ID NO: 1470 - protein, 7 aa, Artificial Sequence
  Description of Artificial Sequence: Synthetic peptide
HGGGHHG

SEQ ID NO: 1471 - protein, 7 aa, Artificial Sequence
  Description of Artificial Sequence: Synthetic peptide
HGGGGHH

SEQ ID NO: 1472 - protein, 7 aa, Artificial Sequence
  Description of Artificial Sequence: Synthetic peptide
HHGHGGG

SEQ ID NO: 1473 - protein, 7 aa, Artificial Sequence
  Description of Artificial Sequence: Synthetic peptide
HHGGHGG

SEQ ID NO: 1474 - protein, 7 aa, Artificial Sequence
  Description of Artificial Sequence: Synthetic peptide
HHGGGHG

SEQ ID NO: 1475 - protein, 7 aa, Artificial Sequence
  Description of Artificial Sequence: Synthetic peptide
HHGGGGH

SEQ ID NO: 1476 - protein, 7 aa, Artificial Sequence
  Description of Artificial Sequence: Synthetic peptide
GHHHGGG

SEQ ID NO: 1477 - protein, 7 aa, Artificial Sequence
  Description of Artificial Sequence: Synthetic peptide
GHHGHGG

SEQ ID NO: 1478 - protein, 7 aa, Artificial Sequence
  Description of Artificial Sequence: Synthetic peptide
GHHGGHG

SEQ ID NO: 1479 - protein, 7 aa, Artificial Sequence
  Description of Artificial Sequence: Synthetic peptide
GHHGGGH

SEQ ID NO: 1480 - protein, 7 aa, Artificial Sequence
  Description of Artificial Sequence: Synthetic peptide
GHGHHGG

SEQ ID NO: 1481 - protein, 7 aa, Artificial Sequence
  Description of Artificial Sequence: Synthetic peptide
GHGGHHG

SEQ ID NO: 1482 - protein, 7 aa, Artificial Sequence
  Description of Artificial Sequence: Synthetic peptide
GHGGGHH

SEQ ID NO: 1483 - protein, 7 aa, Artificial Sequence
  Description of Artificial Sequence: Synthetic peptide
GHGHGHG

SEQ ID NO: 1484 - protein, 7 aa, Artificial Sequence
  Description of Artificial Sequence: Synthetic peptide
GHGHGGH

SEQ ID NO: 1485 - protein, 7 aa, Artificial Sequence
  Description of Artificial Sequence: Synthetic peptide
GHGGHGH

SEQ ID NO: 1486 - protein, 7 aa, Artificial Sequence
  Description of Artificial Sequence: Synthetic peptide
GGHHHGG

SEQ ID NO: 1487 - protein, 7 aa, Artificial Sequence
  Description of Artificial Sequence: Synthetic peptide
GGHHGHG

SEQ ID NO: 1488 - protein, 7 aa, Artificial Sequence
  Description of Artificial Sequence: Synthetic peptide
GGHHGGH

SEQ ID NO: 1489 - protein, 7 aa, Artificial Sequence
  Description of Artificial Sequence: Synthetic peptide
GGHGHHG

SEQ ID NO: 1490 - protein, 7 aa, Artificial Sequence
  Description of Artificial Sequence: Synthetic peptide
GGHGHGH

SEQ ID NO: 1491 - protein, 7 aa, Artificial Sequence
  Description of Artificial Sequence: Synthetic peptide
GGHGGHH

SEQ ID NO: 1492 - protein, 7 aa, Artificial Sequence
  Description of Artificial Sequence: Synthetic peptide
GGGHHHG

SEQ ID NO: 1493 - protein, 7 aa, Artificial Sequence
  Description of Artificial Sequence: Synthetic peptide
GGGHHGH

SEQ ID NO: 1494 - protein, 7 aa, Artificial Sequence
  Description of Artificial Sequence: Synthetic peptide
GGGHGHH

SEQ ID NO: 1495 - protein, 7 aa, Artificial Sequence
  Description of Artificial Sequence: Synthetic peptide
GGGGGHH

SEQ ID NO: 1496 - protein, 7 aa, Artificial Sequence
  Description of Artificial Sequence: Synthetic peptide
HHGGGGG

SEQ ID NO: 1497 - protein, 7 aa, Artificial Sequence
  Description of Artificial Sequence: Synthetic peptide
HGHGGGG

SEQ ID NO: 1498 - protein, 7 aa, Artificial Sequence
  Description of Artificial Sequence: Synthetic peptide
HGGHGGG

SEQ ID NO: 1499 - protein, 7 aa, Artificial Sequence
  Description of Artificial Sequence: Synthetic peptide
HGGGHGG

SEQ ID NO: 1500 - protein, 7 aa, Artificial Sequence
  Description of Artificial Sequence: Synthetic peptide
HGGGGHG

SEQ ID NO: 1501 - protein, 7 aa, Artificial Sequence
  Description of Artificial Sequence: Synthetic peptide
HGGGGGH

SEQ ID NO: 1502 - protein, 7 aa, Artificial Sequence
  Description of Artificial Sequence: Synthetic peptide
GHHGGGG

SEQ ID NO: 1503 - protein, 7 aa, Artificial Sequence
  Description of Artificial Sequence: Synthetic peptide
GHGHGGG

SEQ ID NO: 1504 - protein, 7 aa, Artificial Sequence
  Description of Artificial Sequence: Synthetic peptide
GHGGHGG

SEQ ID NO: 1505 - protein, 7 aa, Artificial Sequence
  Description of Artificial Sequence: Synthetic peptide
GHGGGHG

SEQ ID NO: 1506 - protein, 7 aa, Artificial Sequence
  Description of Artificial Sequence: Synthetic peptide
GHGGGGH

SEQ ID NO: 1507 - protein, 7 aa, Artificial Sequence
  Description of Artificial Sequence: Synthetic peptide
GGHHGGG

SEQ ID NO: 1508 - protein, 7 aa, Artificial Sequence
  Description of Artificial Sequence: Synthetic peptide
GGHGHGG

SEQ ID NO: 1509 - protein, 7 aa, Artificial Sequence
  Description of Artificial Sequence: Synthetic peptide
GGHGGHG

SEQ ID NO: 1510 - protein, 7 aa, Artificial Sequence
  Description of Artificial Sequence: Synthetic peptide
GGHGGGH

SEQ ID NO: 1511 - protein, 7 aa, Artificial Sequence
  Description of Artificial Sequence: Synthetic peptide
GGGHHGG

SEQ ID NO: 1512 - protein, 7 aa, Artificial Sequence
  Description of Artificial Sequence: Synthetic peptide
GGGHGHG

SEQ ID NO: 1513 - protein, 7 aa, Artificial Sequence
  Description of Artificial Sequence: Synthetic peptide
GGGHGGH

SEQ ID NO: 1514 - protein, 7 aa, Artificial Sequence
  Description of Artificial Sequence: Synthetic peptide
GGGGHHG

SEQ ID NO: 1515 - protein, 7 aa, Artificial Sequence
  Description of Artificial Sequence: Synthetic peptide
GGGGHGH

SEQ ID NO: 1516 - protein, 7 aa, Artificial Sequence
  Description of Artificial Sequence: Synthetic peptide
GGGGGGH

SEQ ID NO: 1517 - protein, 7 aa, Artificial Sequence
  Description of Artificial Sequence: Synthetic peptide
HGGGGGG

SEQ ID NO: 1518 - protein, 7 aa, Artificial Sequence
  Description of Artificial Sequence: Synthetic peptide
GHGGGGG

SEQ ID NO: 1519 - protein, 7 aa, Artificial Sequence
  Description of Artificial Sequence: Synthetic peptide
GGHGGGG

SEQ ID NO: 1520 - protein, 7 aa, Artificial Sequence
  Description of Artificial Sequence: Synthetic peptide
GGGHGGG

SEQ ID NO: 1521 - protein, 7 aa, Artificial Sequence
  Description of Artificial Sequence: Synthetic peptide
GGGGHGG

SEQ ID NO: 1522 - protein, 7 aa, Artificial Sequence
  Description of Artificial Sequence: Synthetic peptide
GGGGGHG

SEQ ID NO: 1523 - protein, 4 aa, Artificial Sequence
  Description of Artificial Sequence: Synthetic peptide
GGGN

SEQ ID NO: 1524 - protein, 4 aa, Artificial Sequence
  Description of Artificial Sequence: Synthetic peptide
NGGG

SEQ ID NO: 1525 - protein, 4 aa, Artificial Sequence
  Description of Artificial Sequence: Synthetic peptide
GNGG

SEQ ID NO: 1526 - protein, 4 aa, Artificial Sequence
  Description of Artificial Sequence: Synthetic peptide
GGNG

SEQ ID NO: 1527 - protein, 5 aa, Artificial Sequence
  Description of Artificial Sequence: Synthetic peptide
GGGGN

SEQ ID NO: 1528 - protein, 5 aa, Artificial Sequence
  Description of Artificial Sequence: Synthetic peptide
NGGGG

SEQ ID NO: 1529 - protein, 5 aa, Artificial Sequence
  Description of Artificial Sequence: Synthetic peptide
GNGGG

SEQ ID NO: 1530 - protein, 5 aa, Artificial Sequence
  Description of Artificial Sequence: Synthetic peptide
GGNGG

SEQ ID NO: 1531 - protein, 5 aa, Artificial Sequence
  Description of Artificial Sequence: Synthetic peptide
GGGNG

SEQ ID NO: 1532 - protein, 5 aa, Artificial Sequence
  Description of Artificial Sequence: Synthetic peptide
GGGNN

SEQ ID NO: 1533 - protein, 5 aa, Artificial Sequence
  Description of Artificial Sequence: Synthetic peptide
NNGGG

SEQ ID NO: 1534 - protein, 5 aa, Artificial Sequence
  Description of Artificial Sequence: Synthetic peptide
NGNGG

SEQ ID NO: 1535 - protein, 5 aa, Artificial Sequence
  Description of Artificial Sequence: Synthetic peptide
NGGNG

SEQ ID NO: 1536 - protein, 5 aa, Artificial Sequence
  Description of Artificial Sequence: Synthetic peptide
NGGGN

SEQ ID NO: 1537 - protein, 5 aa, Artificial Sequence
  Description of Artificial Sequence: Synthetic peptide
GNNGG

SEQ ID NO: 1538 - protein, 5 aa, Artificial Sequence
  Description of Artificial Sequence: Synthetic peptide
GNGNG

SEQ ID NO: 1539 - protein, 5 aa, Artificial Sequence
  Description of Artificial Sequence: Synthetic peptide
GNGGN

SEQ ID NO: 1540 - protein, 5 aa, Artificial Sequence
  Description of Artificial Sequence: Synthetic peptide
GGNNG

SEQ ID NO: 1541 - protein, 5 aa, Artificial Sequence
  Description of Artificial Sequence: Synthetic peptide
GGNGN

SEQ ID NO: 1542 - protein, 6 aa, Artificial Sequence
  Description of Artificial Sequence: Synthetic peptide
GGGGGN

SEQ ID NO: 1543 - protein, 6 aa, Artificial Sequence
  Description of Artificial Sequence: Synthetic peptide
NGGGGG

SEQ ID NO: 1544 - protein, 6 aa, Artificial Sequence
  Description of Artificial Sequence: Synthetic peptide
GNGGGG

SEQ ID NO: 1545 - protein, 6 aa, Artificial Sequence
  Description of Artificial Sequence: Synthetic peptide
GGNGGG

SEQ ID NO: 1546 - protein, 6 aa, Artificial Sequence
  Description of Artificial Sequence: Synthetic peptide
GGGNGG

SEQ ID NO: 1547 - protein, 6 aa, Artificial Sequence
  Description of Artificial Sequence: Synthetic peptide
GGGGNG

SEQ ID NO: 1548 - protein, 6 aa, Artificial Sequence
  Description of Artificial Sequence: Synthetic peptide
GGGGNN

SEQ ID NO: 1549 - protein, 6 aa, Artificial Sequence
  Description of Artificial Sequence: Synthetic peptide
NNGGGG

SEQ ID NO: 1550 - protein, 6 aa, Artificial Sequence
  Description of Artificial Sequence: Synthetic peptide
NGNGGG

SEQ ID NO: 1551 - protein, 6 aa, Artificial Sequence
  Description of Artificial Sequence: Synthetic peptide
NGGNGG

SEQ ID NO: 1552 - protein, 6 aa, Artificial Sequence
  Description of Artificial Sequence: Synthetic peptide
NGGGNG

SEQ ID NO: 1553 - protein, 6 aa, Artificial Sequence
  Description of Artificial Sequence: Synthetic peptide
NGGGGN

SEQ ID NO: 1554 - protein, 6 aa, Artificial Sequence
  Description of Artificial Sequence: Synthetic peptide
GNNGGG

SEQ ID NO: 1555 - protein, 6 aa, Artificial Sequence
  Description of Artificial Sequence: Synthetic peptide
GNGNGG

SEQ ID NO: 1556 - protein, 6 aa, Artificial Sequence
  Description of Artificial Sequence: Synthetic peptide
GNGGNG

SEQ ID NO: 1557 - protein, 6 aa, Artificial Sequence
  Description of Artificial Sequence: Synthetic peptide
GNGGGN

SEQ ID NO: 1558 - protein, 6 aa, Artificial Sequence
  Description of Artificial Sequence: Synthetic peptide
GGNNGG

SEQ ID NO: 1559 - protein, 6 aa, Artificial Sequence
  Description of Artificial Sequence: Synthetic peptide
GGNGNG

SEQ ID NO: 1560 - protein, 6 aa, Artificial Sequence
  Description of Artificial Sequence: Synthetic peptide
GGNGGN

SEQ ID NO: 1561 - protein, 6 aa, Artificial Sequence
  Description of Artificial Sequence: Synthetic peptide
GGGNNG

SEQ ID NO: 1562 - protein, 6 aa, Artificial Sequence
  Description of Artificial Sequence: Synthetic peptide
GGGNGN

SEQ ID NO: 1563 - protein, 7 aa, Artificial Sequence
  Description of Artificial Sequence: Synthetic peptide
GGGGNNN

SEQ ID NO: 1564 - protein, 7 aa, Artificial Sequence
  Description of Artificial Sequence: Synthetic peptide
NNNGGGG

SEQ ID NO: 1565 - protein, 7 aa, Artificial Sequence
  Description of Artificial Sequence: Synthetic peptide
NGNNGGG

SEQ ID NO: 1566 - protein, 7 aa, Artificial Sequence
  Description of Artificial Sequence: Synthetic peptide
NGNGNGG

SEQ ID NO: 1567 - protein, 7 aa, Artificial Sequence
  Description of Artificial Sequence: Synthetic peptide
NGNGGNG

SEQ ID NO: 1568 - protein, 7 aa, Artificial Sequence
  Description of Artificial Sequence: Synthetic peptide
NGNGGGN

SEQ ID NO: 1569 - protein, 7 aa, Artificial Sequence
  Description of Artificial Sequence: Synthetic peptide
NGGNNGG

SEQ ID NO: 1570 - protein, 7 aa, Artificial Sequence
  Description of Artificial Sequence: Synthetic peptide
NGGNGNG

SEQ ID NO: 1571 - protein, 7 aa, Artificial Sequence
  Description of Artificial Sequence: Synthetic peptide
NGGNGGN

SEQ ID NO: 1572 - protein, 7 aa, Artificial Sequence
  Description of Artificial Sequence: Synthetic peptide
NGGGNGN

SEQ ID NO: 1573 - protein, 7 aa, Artificial Sequence
  Description of Artificial Sequence: Synthetic peptide
NGGGNNG

SEQ ID NO: 1574 - protein, 7 aa, Artificial Sequence
  Description of Artificial Sequence: Synthetic peptide
NGGGGNN

SEQ ID NO: 1575 - protein, 7 aa, Artificial Sequence
  Description of Artificial Sequence: Synthetic peptide
NNGNGGG

SEQ ID NO: 1576 - protein, 7 aa, Artificial Sequence
  Description of Artificial Sequence: Synthetic peptide
NNGGNGG

SEQ ID NO: 1577 - protein, 7 aa, Artificial Sequence
  Description of Artificial Sequence: Synthetic peptide
NNGGGNG

SEQ ID NO: 1578 - protein, 7 aa, Artificial Sequence
  Description of Artificial Sequence: Synthetic peptide
NNGGGGN

SEQ ID NO: 1579 - protein, 7 aa, Artificial Sequence
  Description of Artificial Sequence: Synthetic peptide
GNNNGGG

SEQ ID NO: 1580 - protein, 7 aa, Artificial Sequence
  Description of Artificial Sequence: Synthetic peptide
GNNGNGG

SEQ ID NO: 1581 - protein, 7 aa, Artificial Sequence
  Description of Artificial Sequence: Synthetic peptide
GNNGGNG

SEQ ID NO: 1582 - protein, 7 aa, Artificial Sequence
  Description of Artificial Sequence: Synthetic peptide
GNNGGGN

SEQ ID NO: 1583 - protein, 7 aa, Artificial Sequence
  Description of Artificial Sequence: Synthetic peptide
GNGNNGG

SEQ ID NO: 1584 - protein, 7 aa, Artificial Sequence
  Description of Artificial Sequence: Synthetic peptide
GNGGNNG

SEQ ID NO: 1585 - protein, 7 aa, Artificial Sequence
  Description of Artificial Sequence: Synthetic peptide
GNGGGNN

SEQ ID NO: 1586 - protein, 7 aa, Artificial Sequence
  Description of Artificial Sequence: Synthetic peptide
GNGNGNG

SEQ ID NO: 1587 - protein, 7 aa, Artificial Sequence
  Description of Artificial Sequence: Synthetic peptide
GNGNGGN

SEQ ID NO: 1588 - protein, 7 aa, Artificial Sequence
  Description of Artificial Sequence: Synthetic peptide
GNGGNGN

SEQ ID NO: 1589 - protein, 7 aa, Artificial Sequence
  Description of Artificial Sequence: Synthetic peptide
GGNNNGG

SEQ ID NO: 1590 - protein, 7 aa, Artificial Sequence
  Description of Artificial Sequence: Synthetic peptide
GGNNGNG

SEQ ID NO: 1591 - protein, 7 aa, Artificial Sequence
  Description of Artificial Sequence: Synthetic peptide
GGNNGGN

SEQ ID NO: 1592 - protein, 7 aa, Artificial Sequence
  Description of Artificial Sequence: Synthetic peptide
GGNGNNG

SEQ ID NO: 1593 - protein, 7 aa, Artificial Sequence
  Description of Artificial Sequence: Synthetic peptide
GGNGNGN

SEQ ID NO: 1594 - protein, 7 aa, Artificial Sequence
  Description of Artificial Sequence: Synthetic peptide
GGNGGNN

SEQ ID NO: 1595 - protein, 7 aa, Artificial Sequence
  Description of Artificial Sequence: Synthetic peptide
GGGNNNG

SEQ ID NO: 1596 - protein, 7 aa, Artificial Sequence
  Description of Artificial Sequence: Synthetic peptide
GGGNNGN

SEQ ID NO: 1597 - protein, 7 aa, Artificial Sequence
  Description of Artificial Sequence: Synthetic peptide
GGGNGNN

SEQ ID NO: 1598 - protein, 7 aa, Artificial Sequence
  Description of Artificial Sequence: Synthetic peptide
GGGGGNN

SEQ ID NO: 1599 - protein, 7 aa, Artificial Sequence
  Description of Artificial Sequence: Synthetic peptide
NNGGGGG

SEQ ID NO: 1600 - protein, 7 aa, Artificial Sequence
  Description of Artificial Sequence: Synthetic peptide
NGNGGGG

SEQ ID NO: 1601 - protein, 7 aa, Artificial Sequence
  Description of Artificial Sequence: Synthetic peptide
NGGNGGG

SEQ ID NO: 1602 - protein, 7 aa, Artificial Sequence
  Description of Artificial Sequence: Synthetic peptide
NGGGNGG

SEQ ID NO: 1603 - protein, 7 aa, Artificial Sequence
  Description of Artificial Sequence: Synthetic peptide
NGGGGNG

SEQ ID NO: 1604 - protein, 7 aa, Artificial Sequence
  Description of Artificial Sequence: Synthetic peptide
NGGGGGN

SEQ ID NO: 1605 - protein, 7 aa, Artificial Sequence
  Description of Artificial Sequence: Synthetic peptide
GNNGGGG

SEQ ID NO: 1606 - protein, 7 aa, Artificial Sequence
  Description of Artificial Sequence: Synthetic peptide
GNGNGGG

SEQ ID NO: 1607 - protein, 7 aa, Artificial Sequence
  Description of Artificial Sequence: Synthetic peptide
GNGGNGG

SEQ ID NO: 1608 - protein, 7 aa, Artificial Sequence
  Description of Artificial Sequence: Synthetic peptide
GNGGGNG

SEQ ID NO: 1609 - protein, 7 aa, Artificial Sequence
  Description of Artificial Sequence: Synthetic peptide
GNGGGGN

SEQ ID NO: 1610 - protein, 7 aa, Artificial Sequence
  Description of Artificial Sequence: Synthetic peptide
GGNNGGG

SEQ ID NO: 1611 - protein, 7 aa, Artificial Sequence
  Description of Artificial Sequence: Synthetic peptide
GGNGNGG

SEQ ID NO: 1612 - protein, 7 aa, Artificial Sequence
  Description of Artificial Sequence: Synthetic peptide
GGNGGNG

SEQ ID NO: 1613 - protein, 7 aa, Artificial Sequence
  Description of Artificial Sequence: Synthetic peptide
GGNGGGN

SEQ ID NO: 1614 - protein, 7 aa, Artificial Sequence
  Description of Artificial Sequence: Synthetic peptide
GGGNNGG

SEQ ID NO: 1615 - protein, 7 aa, Artificial Sequence
  Description of Artificial Sequence: Synthetic peptide
GGGNGNG

SEQ ID NO: 1616 - protein, 7 aa, Artificial Sequence
  Description of Artificial Sequence: Synthetic peptide
GGGNGGN

SEQ ID NO: 1617 - protein, 7 aa, Artificial Sequence
  Description of Artificial Sequence: Synthetic peptide
GGGGNNG

SEQ ID NO: 1618 - protein, 7 aa, Artificial Sequence
  Description of Artificial Sequence: Synthetic peptide
GGGGNGN

SEQ ID NO: 1619 - protein, 7 aa, Artificial Sequence
  Description of Artificial Sequence: Synthetic peptide
GGGGGGN

SEQ ID NO: 1620 - protein, 7 aa, Artificial Sequence
  Description of Artificial Sequence: Synthetic peptide
NGGGGGG

SEQ ID NO: 1621 - protein, 7 aa, Artificial Sequence
  Description of Artificial Sequence: Synthetic peptide
GNGGGGG

SEQ ID NO: 1622 - protein, 7 aa, Artificial Sequence
  Description of Artificial Sequence: Synthetic peptide
GGNGGGG

SEQ ID NO: 1623 - protein, 7 aa, Artificial Sequence
  Description of Artificial Sequence: Synthetic peptide
GGGNGGG

SEQ ID NO: 1624 - protein, 7 aa, Artificial Sequence
  Description of Artificial Sequence: Synthetic peptide
GGGGNGG

SEQ ID NO: 1625 - protein, 7 aa, Artificial Sequence
  Description of Artificial Sequence: Synthetic peptide
GGGGGNG

SEQ ID NO: 1626 - protein, 4 aa, Artificial Sequence
  Description of Artificial Sequence: Synthetic peptide
GGGD

SEQ ID NO: 1627 - protein, 4 aa, Artificial Sequence
  Description of Artificial Sequence: Synthetic peptide
DGGG

SEQ ID NO: 1628 - protein, 4 aa, Artificial Sequence
  Description of Artificial Sequence: Synthetic peptide
GDGG

SEQ ID NO: 1629 - protein, 4 aa, Artificial Sequence
  Description of Artificial Sequence: Synthetic peptide
GGDG

SEQ ID NO: 1630 - protein, 5 aa, Artificial Sequence
  Description of Artificial Sequence: Synthetic peptide
GGGGD

SEQ ID NO: 1631 - protein, 5 aa, Artificial Sequence
  Description of Artificial Sequence: Synthetic peptide
DGGGG

SEQ ID NO: 1632 - protein, 5 aa, Artificial Sequence
  Description of Artificial Sequence: Synthetic peptide
GDGGG

SEQ ID NO: 1633 - protein, 5 aa, Artificial Sequence
  Description of Artificial Sequence: Synthetic peptide
GGDGG

SEQ ID NO: 1634 - protein, 5 aa, Artificial Sequence
  Description of Artificial Sequence: Synthetic peptide
GGGDG

SEQ ID NO: 1635 - protein, 5 aa, Artificial Sequence
  Description of Artificial Sequence: Synthetic peptide
GGGDD

SEQ ID NO: 1636 - protein, 5 aa, Artificial Sequence
  Description of Artificial Sequence: Synthetic peptide
DDGGG

SEQ ID NO: 1637 - protein, 5 aa, Artificial Sequence
  Description of Artificial Sequence: Synthetic peptide
DGDGG

SEQ ID NO: 1638 - protein, 5 aa, Artificial Sequence
  Description of Artificial Sequence: Synthetic peptide
DGGDG

SEQ ID NO: 1639 - protein, 5 aa, Artificial Sequence
  Description of Artificial Sequence: Synthetic peptide
DGGGD

SEQ ID NO: 1640 - protein, 5 aa, Artificial Sequence
  Description of Artificial Sequence: Synthetic peptide
GDDGG

SEQ ID NO: 1641 - protein, 5 aa, Artificial Sequence
  Description of Artificial Sequence: Synthetic peptide
GDGDG

SEQ ID NO: 1642 - protein, 5 aa, Artificial Sequence
  Description of Artificial Sequence: Synthetic peptide
GDGGD

SEQ ID NO: 1643 - protein, 5 aa, Artificial Sequence
  Description of Artificial Sequence: Synthetic peptide
GGDDG

SEQ ID NO: 1644 - protein, 5 aa, Artificial Sequence
  Description of Artificial Sequence: Synthetic peptide
GGDGD

SEQ ID NO: 1645 - protein, 6 aa, Artificial Sequence
  Description of Artificial Sequence: Synthetic peptide
GGGGGD

SEQ ID NO: 1646 - protein, 6 aa, Artificial Sequence
  Description of Artificial Sequence: Synthetic peptide
DGGGGG

SEQ ID NO: 1647 - protein, 6 aa, Artificial Sequence
  Description of Artificial Sequence: Synthetic peptide
GDGGGG

SEQ ID NO: 1648 - protein, 6 aa, Artificial Sequence
  Description of Artificial Sequence: Synthetic peptide
GGDGGG

SEQ ID NO: 1649 - protein, 6 aa, Artificial Sequence
  Description of Artificial Sequence: Synthetic peptide
GGGDGG

SEQ ID NO: 1650 - protein, 6 aa, Artificial Sequence
  Description of Artificial Sequence: Synthetic peptide
GGGGDG

SEQ ID NO: 1651 - protein, 6 aa, Artificial Sequence
  Description of Artificial Sequence: Synthetic peptide
GGGGDD

SEQ ID NO: 1652 - protein, 6 aa, Artificial Sequence
  Description of Artificial Sequence: Synthetic peptide
DDGGGG

SEQ ID NO: 1653 - protein, 6 aa, Artificial Sequence
  Description of Artificial Sequence: Synthetic peptide
DGDGGG

SEQ ID NO: 1654 - protein, 6 aa, Artificial Sequence
  Description of Artificial Sequence: Synthetic peptide
DGGDGG

SEQ ID NO: 1655 - protein, 6 aa, Artificial Sequence
  Description of Artificial Sequence: Synthetic peptide
DGGGDG

SEQ ID NO: 1656 - protein, 6 aa, Artificial Sequence
  Description of Artificial Sequence: Synthetic peptide
DGGGGD

SEQ ID NO: 1657 - protein, 6 aa, Artificial Sequence
  Description of Artificial Sequence: Synthetic peptide
GDDGGG

SEQ ID NO: 1658 - protein, 6 aa, Artificial Sequence
  Description of Artificial Sequence: Synthetic peptide
GDGDGG

SEQ ID NO: 1659 - protein, 6 aa, Artificial Sequence
  Description of Artificial Sequence: Synthetic peptide
GDGGDG

SEQ ID NO: 1660 - protein, 6 aa, Artificial Sequence
  Description of Artificial Sequence: Synthetic peptide
GDGGGD

SEQ ID NO: 1661 - protein, 6 aa, Artificial Sequence
  Description of Artificial Sequence: Synthetic peptide
GGDDGG

SEQ ID NO: 1662 - protein, 6 aa, Artificial Sequence
  Description of Artificial Sequence: Synthetic peptide
GGDGDG

SEQ ID NO: 1663 - protein, 6 aa, Artificial Sequence
  Description of Artificial Sequence: Synthetic peptide
GGDGGD

SEQ ID NO: 1664 - protein, 6 aa, Artificial Sequence
  Description of Artificial Sequence: Synthetic peptide
GGGDDG

SEQ ID NO: 1665 - protein, 6 aa, Artificial Sequence
  Description of Artificial Sequence: Synthetic peptide
GGGDGD

SEQ ID NO: 1666 - protein, 7 aa, Artificial Sequence
  Description of Artificial Sequence: Synthetic peptide
GGGGDDD

SEQ ID NO: 1667 - protein, 7 aa, Artificial Sequence
  Description of Artificial Sequence: Synthetic peptide
DDDGGGG

SEQ ID NO: 1668 - protein, 7 aa, Artificial Sequence
  Description of Artificial Sequence: Synthetic peptide
DGDDGGG

SEQ ID NO: 1669 - protein, 7 aa, Artificial Sequence
  Description of Artificial Sequence: Synthetic peptide
DGDGDGG

SEQ ID NO: 1670 - protein, 7 aa, Artificial Sequence
  Description of Artificial Sequence: Synthetic peptide
DGDGGDG

SEQ ID NO: 1671 - protein, 7 aa, Artificial Sequence
  Description of Artificial Sequence: Synthetic peptide
DGDGGGD

SEQ ID NO: 1672 - protein, 7 aa, Artificial Sequence
  Description of Artificial Sequence: Synthetic peptide
DGGDDGG

SEQ ID NO: 1673 - protein, 7 aa, Artificial Sequence
  Description of Artificial Sequence: Synthetic peptide
DGGDGDG

SEQ ID NO: 1674 - protein, 7 aa, Artificial Sequence
  Description of Artificial Sequence: Synthetic peptide
DGGDGGD

SEQ ID NO: 1675 - protein, 7 aa, Artificial Sequence
  Description of Artificial Sequence: Synthetic peptide
DGGGDGD

SEQ ID NO: 1676 - protein, 7 aa, Artificial Sequence
  Description of Artificial Sequence: Synthetic peptide
DGGGDDG

SEQ ID NO: 1677 - protein, 7 aa, Artificial Sequence
  Description of Artificial Sequence: Synthetic peptide
DGGGGDD

SEQ ID NO: 1678 - protein, 7 aa, Artificial Sequence
  Description of Artificial Sequence: Synthetic peptide
DDGDGGG

SEQ ID NO: 1679 - protein, 7 aa, Artificial Sequence
  Description of Artificial Sequence: Synthetic peptide
DDGGDGG

SEQ ID NO: 1680 - protein, 7 aa, Artificial Sequence
  Description of Artificial Sequence: Synthetic peptide
DDGGGDG

SEQ ID NO: 1681 - protein, 7 aa, Artificial Sequence
  Description of Artificial Sequence: Synthetic peptide
DDGGGGD

SEQ ID NO: 1682 - protein, 7 aa, Artificial Sequence
  Description of Artificial Sequence: Synthetic peptide
GDDDGGG

SEQ ID NO: 1683 - protein, 7 aa, Artificial Sequence
  Description of Artificial Sequence: Synthetic peptide
GDDGDGG

SEQ ID NO: 1684 - protein, 7 aa, Artificial Sequence
  Description of Artificial Sequence: Synthetic peptide
GDDGGDG

SEQ ID NO: 1685 - protein, 7 aa, Artificial Sequence
  Description of Artificial Sequence: Synthetic peptide
GDDGGGD

SEQ ID NO: 1686 - protein, 7 aa, Artificial Sequence
  Description of Artificial Sequence: Synthetic peptide
GDGDDGG

SEQ ID NO: 1687 - protein, 7 aa, Artificial Sequence
  Description of Artificial Sequence: Synthetic peptide
GDGGDDG

SEQ ID NO: 1688 - protein, 7 aa, Artificial Sequence
  Description of Artificial Sequence: Synthetic peptide
GDGGGDD

SEQ ID NO: 1689 - protein, 7 aa, Artificial Sequence
  Description of Artificial Sequence: Synthetic peptide
GDGDGDG

SEQ ID NO: 1690 - protein, 7 aa, Artificial Sequence
  Description of Artificial Sequence: Synthetic peptide
GDGDGGD

SEQ ID NO: 1691 - protein, 7 aa, Artificial Sequence
  Description of Artificial Sequence: Synthetic peptide
GDGGDGD

SEQ ID NO: 1692 - protein, 7 aa, Artificial Sequence
  Description of Artificial Sequence: Synthetic peptide
GGDDDGG

SEQ ID NO: 1693 - protein, 7 aa, Artificial Sequence
  Description of Artificial Sequence: Synthetic peptide
GGDDGDG

SEQ ID NO: 1694 - protein, 7 aa, Artificial Sequence
  Description of Artificial Sequence: Synthetic peptide
GGDDGGD

SEQ ID NO: 1695 - protein, 7 aa, Artificial Sequence
  Description of Artificial Sequence: Synthetic peptide
GGDGDDG

SEQ ID NO: 1696 - protein, 7 aa, Artificial Sequence
  Description of Artificial Sequence: Synthetic peptide
GGDGDGD

SEQ ID NO: 1697 - protein, 7 aa, Artificial Sequence
  Description of Artificial Sequence: Synthetic peptide
GGDGGDD

SEQ ID NO: 1698 - protein, 7 aa, Artificial Sequence
  Description of Artificial Sequence: Synthetic peptide
GGGDDDG

SEQ ID NO: 1699 - protein, 7 aa, Artificial Sequence
  Description of Artificial Sequence: Synthetic peptide
GGGDDGD

SEQ ID NO: 1700 - protein, 7 aa, Artificial Sequence
  Description of Artificial Sequence: Synthetic peptide
GGGDGDD

SEQ ID NO: 1701 - protein, 7 aa, Artificial Sequence
  Description of Artificial Sequence: Synthetic peptide
GGGGGDD

SEQ ID NO: 1702 - protein, 7 aa, Artificial Sequence
  Description of Artificial Sequence: Synthetic peptide
DDGGGGG

SEQ ID NO: 1703 - protein, 7 aa, Artificial Sequence
  Description of Artificial Sequence: Synthetic peptide
DGDGGGG

SEQ ID NO: 1704 - protein, 7 aa, Artificial Sequence
  Description of Artificial Sequence: Synthetic peptide
DGGDGGG

SEQ ID NO: 1705 - protein, 7 aa, Artificial Sequence
  Description of Artificial Sequence: Synthetic peptide
DGGGDGG

SEQ ID NO: 1706 - protein, 7 aa, Artificial Sequence
  Description of Artificial Sequence: Synthetic peptide
DGGGGDG

SEQ ID NO: 1707 - protein, 7 aa, Artificial Sequence
  Description of Artificial Sequence: Synthetic peptide
DGGGGGD

SEQ ID NO: 1708 - protein, 7 aa, Artificial Sequence
  Description of Artificial Sequence: Synthetic peptide
GDDGGGG

SEQ ID NO: 1709 - protein, 7 aa, Artificial Sequence
  Description of Artificial Sequence: Synthetic peptide
GDGDGGG

SEQ ID NO: 1710 - protein, 7 aa, Artificial Sequence
  Description of Artificial Sequence: Synthetic peptide
GDGGDGG

SEQ ID NO: 1711 - protein, 7 aa, Artificial Sequence
  Description of Artificial Sequence: Synthetic peptide
GDGGGDG

SEQ ID NO: 1712 - protein, 7 aa, Artificial Sequence
  Description of Artificial Sequence: Synthetic peptide
GDGGGGD

SEQ ID NO: 1713 - protein, 7 aa, Artificial Sequence
  Description of Artificial Sequence: Synthetic peptide
GGDDGGG

SEQ ID NO: 1714 - protein, 7 aa, Artificial Sequence
  Description of Artificial Sequence: Synthetic peptide
GGDGDGG

SEQ ID NO: 1715 - protein, 7 aa, Artificial Sequence
  Description of Artificial Sequence: Synthetic peptide
GGDGGDG

SEQ ID NO: 1716 - protein, 7 aa, Artificial Sequence
  Description of Artificial Sequence: Synthetic peptide
GGDGGGD

SEQ ID NO: 1717 - protein, 7 aa, Artificial Sequence
  Description of Artificial Sequence: Synthetic peptide
GGGDDGG

SEQ ID NO: 1718 - protein, 7 aa, Artificial Sequence
  Description of Artificial Sequence: Synthetic peptide
GGGDGDG

SEQ ID NO: 1719 - protein, 7 aa, Artificial Sequence
  Description of Artificial Sequence: Synthetic peptide
GGGDGGD

SEQ ID NO: 1720 - protein, 7 aa, Artificial Sequence
  Description of Artificial Sequence: Synthetic peptide
GGGGDDG

SEQ ID NO: 1721 - protein, 7 aa, Artificial Sequence
  Description of Artificial Sequence: Synthetic peptide
GGGGDGD

SEQ ID NO: 1722 - protein, 7 aa, Artificial Sequence
  Description of Artificial Sequence: Synthetic peptide
GGGGGGD

SEQ ID NO: 1723 - protein, 7 aa, Artificial Sequence
  Description of Artificial Sequence: Synthetic peptide
DGGGGGG

SEQ ID NO: 1724 - protein, 7 aa, Artificial Sequence
  Description of Artificial Sequence: Synthetic peptide
GDGGGGG

SEQ ID NO: 1725 - protein, 7 aa, Artificial Sequence
  Description of Artificial Sequence: Synthetic peptide
GGDGGGG

SEQ ID NO: 1726 - protein, 7 aa, Artificial Sequence
  Description of Artificial Sequence: Synthetic peptide
GGGDGGG

SEQ ID NO: 1727 - protein, 7 aa, Artificial Sequence
  Description of Artificial Sequence: Synthetic peptide
GGGGDGG

SEQ ID NO: 1728 - protein, 7 aa, Artificial Sequence
  Description of Artificial Sequence: Synthetic peptide
GGGGGDG

SEQ ID NO: 1729 - protein, 4 aa, Artificial Sequence
  Description of Artificial Sequence: Synthetic peptide
QQQT

SEQ ID NO: 1730 - protein, 4 aa, Artificial Sequence
  Description of Artificial Sequence: Synthetic peptide
TQQQ

SEQ ID NO: 1731 - protein, 4 aa, Artificial Sequence
  Description of Artificial Sequence: Synthetic peptide
QTQQ

SEQ ID NO: 1732 - protein, 4 aa, Artificial Sequence
  Description of Artificial Sequence: Synthetic peptide
QQTQ

SEQ ID NO: 1733 - protein, 5 aa, Artificial Sequence
  Description of Artificial Sequence: Synthetic peptide
QQQQT

SEQ ID NO: 1734 - protein, 5 aa, Artificial Sequence
  Description of Artificial Sequence: Synthetic peptide
TQQQQ

SEQ ID NO: 1735 - protein, 5 aa, Artificial Sequence
  Description of Artificial Sequence: Synthetic peptide
QTQQQ

SEQ ID NO: 1736 - protein, 5 aa, Artificial Sequence
  Description of Artificial Sequence: Synthetic peptide
QQTQQ

SEQ ID NO: 1737 - protein, 5 aa, Artificial Sequence
  Description of Artificial Sequence: Synthetic peptide
QQQTQ

SEQ ID NO: 1738 - protein, 5 aa, Artificial Sequence
  Description of Artificial Sequence: Synthetic peptide
QQQTT

SEQ ID NO: 1739 - protein, 5 aa, Artificial Sequence
  Description of Artificial Sequence: Synthetic peptide
TTQQQ

SEQ ID NO: 1740 - protein, 5 aa, Artificial Sequence
  Description of Artificial Sequence: Synthetic peptide
TQTQQ

SEQ ID NO: 1741 - protein, 5 aa, Artificial Sequence
  Description of Artificial Sequence: Synthetic peptide
TQQTQ

SEQ ID NO: 1742 - protein, 5 aa, Artificial Sequence
  Description of Artificial Sequence: Synthetic peptide
TQQQT

SEQ ID NO: 1743 - protein, 5 aa, Artificial Sequence
  Description of Artificial Sequence: Synthetic peptide
QTTQQ

SEQ ID NO: 1744 - protein, 5 aa, Artificial Sequence
  Description of Artificial Sequence: Synthetic peptide
QTQTQ

SEQ ID NO: 1745 - protein, 5 aa, Artificial Sequence
  Description of Artificial Sequence: Synthetic peptide
QTQQT

SEQ ID NO: 1746 - protein, 5 aa, Artificial Sequence
  Description of Artificial Sequence: Synthetic peptide
QQTTQ

SEQ ID NO: 1747 - protein, 5 aa, Artificial Sequence
  Description of Artificial Sequence: Synthetic peptide
QQTQT

SEQ ID NO: 1748 - protein, 6 aa, Artificial Sequence
  Description of Artificial Sequence: Synthetic peptide
QQQQQT

SEQ ID NO: 1749 - protein, 6 aa, Artificial Sequence
  Description of Artificial Sequence: Synthetic peptide
TQQQQQ

SEQ ID NO: 1750 - protein, 6 aa, Artificial Sequence
  Description of Artificial Sequence: Synthetic peptide
QTQQQQ

SEQ ID NO: 1751 - protein, 6 aa, Artificial Sequence
  Description of Artificial Sequence: Synthetic peptide
QQTQQQ

SEQ ID NO: 1752 - protein, 6 aa, Artificial Sequence
  Description of Artificial Sequence: Synthetic peptide
QQQTQQ

SEQ ID NO: 1753 - protein, 6 aa, Artificial Sequence
  Description of Artificial Sequence: Synthetic peptide
QQQQTQ

SEQ ID NO: 1754 - protein, 6 aa, Artificial Sequence
  Description of Artificial Sequence: Synthetic peptide
QQQQTT

SEQ ID NO: 1755 - protein, 6 aa, Artificial Sequence
  Description of Artificial Sequence: Synthetic peptide
TTQQQQ

SEQ ID NO: 1756 - protein, 6 aa, Artificial Sequence
  Description of Artificial Sequence: Synthetic peptide
TQTQQQ

SEQ ID NO: 1757 - protein, 6 aa, Artificial Sequence
  Description of Artificial Sequence: Synthetic peptide
TQQTQQ

SEQ ID NO: 1758 - protein, 6 aa, Artificial Sequence
  Description of Artificial Sequence: Synthetic peptide
TQQQTQ

SEQ ID NO: 1759 - protein, 6 aa, Artificial Sequence
  Description of Artificial Sequence: Synthetic peptide
TQQQQT

SEQ ID NO: 1760 - protein, 6 aa, Artificial Sequence
  Description of Artificial Sequence: Synthetic peptide
QTTQQQ

SEQ ID NO: 1761 - protein, 6 aa, Artificial Sequence
  Description of Artificial Sequence: Synthetic peptide
QTQTQQ

SEQ ID NO: 1762 - protein, 6 aa, Artificial Sequence
  Description of Artificial Sequence: Synthetic peptide
QTQQTQ

SEQ ID NO: 1763 - protein, 6 aa, Artificial Sequence
  Description of Artificial Sequence: Synthetic peptide
QTQQQT

SEQ ID NO: 1764 - protein, 6 aa, Artificial Sequence
  Description of Artificial Sequence: Synthetic peptide
QQTTQQ

SEQ ID NO: 1765 - protein, 6 aa, Artificial Sequence
  Description of Artificial Sequence: Synthetic peptide
QQTQTQ

SEQ ID NO: 1766 - protein, 6 aa, Artificial Sequence
  Description of Artificial Sequence: Synthetic peptide
QQTQQT

SEQ ID NO: 1767 - protein, 6 aa, Artificial Sequence
  Description of Artificial Sequence: Synthetic peptide
QQQTTQ

SEQ ID NO: 1768 - protein, 6 aa, Artificial Sequence
  Description of Artificial Sequence: Synthetic peptide
QQQTQT

SEQ ID NO: 1769 - protein, 7 aa, Artificial Sequence
  Description of Artificial Sequence: Synthetic peptide
QQQQTTT

SEQ ID NO: 1770 - protein, 7 aa, Artificial Sequence
  Description of Artificial Sequence: Synthetic peptide
TTTQQQQ

SEQ ID NO: 1771 - protein, 7 aa, Artificial Sequence
  Description of Artificial Sequence: Synthetic peptide
TQTTQQQ

SEQ ID NO: 1772 - protein, 7 aa, Artificial Sequence
  Description of Artificial Sequence: Synthetic peptide
TQTQTQQ

SEQ ID NO: 1773 - protein, 7 aa, Artificial Sequence
  Description of Artificial Sequence: Synthetic peptide
TQTQQTQ

SEQ ID NO: 1774 - protein, 7 aa, Artificial Sequence
  Description of Artificial Sequence: Synthetic peptide
TQTQQQT

SEQ ID NO: 1775 - protein, 7 aa, Artificial Sequence
  Description of Artificial Sequence: Synthetic peptide
TQQTTQQ

SEQ ID NO: 1776 - protein, 7 aa, Artificial Sequence
  Description of Artificial Sequence: Synthetic peptide
TQQTQTQ

SEQ ID NO: 1777 - protein, 7 aa, Artificial Sequence
  Description of Artificial Sequence: Synthetic peptide
TQQTQQT

SEQ ID NO: 1778 - protein, 7 aa, Artificial Sequence
  Description of Artificial Sequence: Synthetic peptide
TQQQTQT

SEQ ID NO: 1779 - protein, 7 aa, Artificial Sequence
  Description of Artificial Sequence: Synthetic peptide
TQQQTTQ

SEQ ID NO: 1780 - protein, 7 aa, Artificial Sequence
  Description of Artificial Sequence: Synthetic peptide
TQQQQTT

SEQ ID NO: 1781 - protein, 7 aa, Artificial Sequence
  Description of Artificial Sequence: Synthetic peptide
TTQTQQQ

SEQ ID NO: 1782 - protein, 7 aa, Artificial Sequence
  Description of Artificial Sequence: Synthetic peptide
TTQQTQQ

SEQ ID NO: 1783 - protein, 7 aa, Artificial Sequence
  Description of Artificial Sequence: Synthetic peptide
TTQQQTQ

SEQ ID NO: 1784 - protein, 7 aa, Artificial Sequence
  Description of Artificial Sequence: Synthetic peptide
TTQQQQT

SEQ ID NO: 1785 - protein, 7 aa, Artificial Sequence
  Description of Artificial Sequence: Synthetic peptide
QTTTQQQ

SEQ ID NO: 1786 - protein, 7 aa, Artificial Sequence
  Description of Artificial Sequence: Synthetic peptide
QTTQTQQ

SEQ ID NO: 1787 - protein, 7 aa, Artificial Sequence
  Description of Artificial Sequence: Synthetic peptide
QTTQQTQ

SEQ ID NO: 1788 - protein, 7 aa, Artificial Sequence
  Description of Artificial Sequence: Synthetic peptide
QTTQQQT

SEQ ID NO: 1789 - protein, 7 aa, Artificial Sequence
  Description of Artificial Sequence: Synthetic peptide
QTQTTQQ

SEQ ID NO: 1790 - protein, 7 aa, Artificial Sequence
  Description of Artificial Sequence: Synthetic peptide
QTQQTTQ

SEQ ID NO: 1791 - protein, 7 aa, Artificial Sequence
  Description of Artificial Sequence: Synthetic peptide
QTQQQTT

SEQ ID NO: 1792 - protein, 7 aa, Artificial Sequence
  Description of Artificial Sequence: Synthetic peptide
QTQTQTQ

SEQ ID NO: 1793 - protein, 7 aa, Artificial Sequence
  Description of Artificial Sequence: Synthetic peptide
QTQTQQT

SEQ ID NO: 1794 - protein, 7 aa, Artificial Sequence
  Description of Artificial Sequence: Synthetic peptide
QTQQTQT

SEQ ID NO: 1795 - protein, 7 aa, Artificial Sequence
  Description of Artificial Sequence: Synthetic peptide
QQTTTQQ

SEQ ID NO: 1796 - protein, 7 aa, Artificial Sequence
  Description of Artificial Sequence: Synthetic peptide
QQTTQTQ

SEQ ID NO: 1797 - protein, 7 aa, Artificial Sequence
  Description of Artificial Sequence: Synthetic peptide
QQTTQQT

SEQ ID NO: 1798 - protein, 7 aa, Artificial Sequence
  Description of Artificial Sequence: Synthetic peptide
QQTQTTQ

SEQ ID NO: 1799 - protein, 7 aa, Artificial Sequence
  Description of Artificial Sequence: Synthetic peptide
QQTQTQT

SEQ ID NO: 1800 - protein, 7 aa, Artificial Sequence
  Description of Artificial Sequence: Synthetic peptide
QQTQQTT

SEQ ID NO: 1801 - protein, 7 aa, Artificial Sequence
  Description of Artificial Sequence: Synthetic peptide
QQQTTTQ

SEQ ID NO: 1802 - protein, 7 aa, Artificial Sequence
  Description of Artificial Sequence: Synthetic peptide
QQQTTQT

SEQ ID NO: 1803 - protein, 7 aa, Artificial Sequence
  Description of Artificial Sequence: Synthetic peptide
QQQTQTT

SEQ ID NO: 1804 - protein, 7 aa, Artificial Sequence
  Description of Artificial Sequence: Synthetic peptide
QQQQQTT

SEQ ID NO: 1805 - protein, 7 aa, Artificial Sequence
  Description of Artificial Sequence: Synthetic peptide
TTQQQQQ

SEQ ID NO: 1806 - protein, 7 aa, Artificial Sequence
  Description of Artificial Sequence: Synthetic peptide
TQTQQQQ

SEQ ID NO: 1807 - protein, 7 aa, Artificial Sequence
  Description of Artificial Sequence: Synthetic peptide
TQQTQQQ

SEQ ID NO: 1808 - protein, 7 aa, Artificial Sequence
  Description of Artificial Sequence: Synthetic peptide
TQQQTQQ

SEQ ID NO: 1809 - protein, 7 aa, Artificial Sequence
  Description of Artificial Sequence: Synthetic peptide
TQQQQTQ

SEQ ID NO: 1810 - protein, 7 aa, Artificial Sequence
  Description of Artificial Sequence: Synthetic peptide
TQQQQQT

SEQ ID NO: 1811 - protein, 7 aa, Artificial Sequence
  Description of Artificial Sequence: Synthetic peptide
QTTQQQQ

SEQ ID NO: 1812 - protein, 7 aa, Artificial Sequence
  Description of Artificial Sequence: Synthetic peptide
QTQTQQQ

SEQ ID NO: 1813 - protein, 7 aa, Artificial Sequence
  Description of Artificial Sequence: Synthetic peptide
QTQQTQQ

SEQ ID NO: 1814 - protein, 7 aa, Artificial Sequence
  Description of Artificial Sequence: Synthetic peptide
QTQQQTQ

SEQ ID NO: 1815 - protein, 7 aa, Artificial Sequence
  Description of Artificial Sequence: Synthetic peptide
QTQQQQT

SEQ ID NO: 1816 - protein, 7 aa, Artificial Sequence
  Description of Artificial Sequence: Synthetic peptide
QQTTQQQ

SEQ ID NO: 1817 - protein, 7 aa, Artificial Sequence
  Description of Artificial Sequence: Synthetic peptide
QQTQTQQ

SEQ ID NO: 1818 - protein, 7 aa, Artificial Sequence
  Description of Artificial Sequence: Synthetic peptide
QQTQQTQ

SEQ ID NO: 1819 - protein, 7 aa, Artificial Sequence
  Description of Artificial Sequence: Synthetic peptide
QQTQQQT

SEQ ID NO: 1820 - protein, 7 aa, Artificial Sequence
  Description of Artificial Sequence: Synthetic peptide
QQQTTQQ

SEQ ID NO: 1821 - protein, 7 aa, Artificial Sequence
  Description of Artificial Sequence: Synthetic peptide
QQQTQTQ

SEQ ID NO: 1822 - protein, 7 aa, Artificial Sequence
  Description of Artificial Sequence: Synthetic peptide
QQQTQQT

SEQ ID NO: 1823 - protein, 7 aa, Artificial Sequence
  Description of Artificial Sequence: Synthetic peptide
QQQQTTQ

SEQ ID NO: 1824 - protein, 7 aa, Artificial Sequence
  Description of Artificial Sequence: Synthetic peptide
QQQQTQT

SEQ ID NO: 1825 - protein, 7 aa, Artificial Sequence
  Description of Artificial Sequence: Synthetic peptide
QQQQQQT

SEQ ID NO: 1826 - protein, 7 aa, Artificial Sequence
  Description of Artificial Sequence: Synthetic peptide
TQQQQQQ

SEQ ID NO: 1827 - protein, 7 aa, Artificial Sequence
  Description of Artificial Sequence: Synthetic peptide
QTQQQQQ

SEQ ID NO: 1828 - protein, 7 aa, Artificial Sequence
  Description of Artificial Sequence: Synthetic peptide
QQTQQQQ

SEQ ID NO: 1829 - protein, 7 aa, Artificial Sequence
  Description of Artificial Sequence: Synthetic peptide
QQQTQQQ

SEQ ID NO: 1830 - protein, 7 aa, Artificial Sequence
  Description of Artificial Sequence: Synthetic peptide
QQQQTQQ

SEQ ID NO: 1831 - protein, 7 aa, Artificial Sequence
  Description of Artificial Sequence: Synthetic peptide
QQQQQTQ

SEQ ID NO: 1832 - protein, 4 aa, Artificial Sequence
  Description of Artificial Sequence: Synthetic peptide
QQQA

SEQ ID NO: 1833 - protein, 4 aa, Artificial Sequence
  Description of Artificial Sequence: Synthetic peptide
AQQQ

SEQ ID NO: 1834 - protein, 4 aa, Artificial Sequence
  Description of Artificial Sequence: Synthetic peptide
QAQQ

SEQ ID NO: 1835 - protein, 4 aa, Artificial Sequence
  Description of Artificial Sequence: Synthetic peptide
QQAQ

SEQ ID NO: 1836 - protein, 5 aa, Artificial Sequence
  Description of Artificial Sequence: Synthetic peptide
QQQQA

SEQ ID NO: 1837 - protein, 5 aa, Artificial Sequence
  Description of Artificial Sequence: Synthetic peptide
AQQQQ

SEQ ID NO: 1838 - protein, 5 aa, Artificial Sequence
  Description of Artificial Sequence: Synthetic peptide
QAQQQ

SEQ ID NO: 1839 - protein, 5 aa, Artificial Sequence
  Description of Artificial Sequence: Synthetic peptide
QQAQQ

SEQ ID NO: 1840 - protein, 5 aa, Artificial Sequence
  Description of Artificial Sequence: Synthetic peptide
QQQAQ

SEQ ID NO: 1841 - protein, 5 aa, Artificial Sequence
  Description of Artificial Sequence: Synthetic peptide
QQQAA

SEQ ID NO: 1842 - protein, 5 aa, Artificial Sequence
  Description of Artificial Sequence: Synthetic peptide
AAQQQ

SEQ ID NO: 1843 - protein, 5 aa, Artificial Sequence
  Description of Artificial Sequence: Synthetic peptide
AQAQQ

SEQ ID NO: 1844 - protein, 5 aa, Artificial Sequence
  Description of Artificial Sequence: Synthetic peptide
AQQAQ

SEQ ID NO: 1845 - protein, 5 aa, Artificial Sequence
  Description of Artificial Sequence: Synthetic peptide
AQQQA

SEQ ID NO: 1846 - protein, 5 aa, Artificial Sequence
  Description of Artificial Sequence: Synthetic peptide
QAAQQ

SEQ ID NO: 1847 - protein, 5 aa, Artificial Sequence
  Description of Artificial Sequence: Synthetic peptide
QAQAQ

SEQ ID NO: 1848 - protein, 5 aa, Artificial Sequence
  Description of Artificial Sequence: Synthetic peptide
QAQQA

SEQ ID NO: 1849 - protein, 5 aa, Artificial Sequence
  Description of Artificial Sequence: Synthetic peptide
QQAAQ

SEQ ID NO: 1850 - protein, 5 aa, Artificial Sequence
  Description of Artificial Sequence: Synthetic peptide
QQAQA

SEQ ID NO: 1851 - protein, 6 aa, Artificial Sequence
  Description of Artificial Sequence: Synthetic peptide
QQQQQA

SEQ ID NO: 1852 - protein, 6 aa, Artificial Sequence
  Description of Artificial Sequence: Synthetic peptide
AQQQQQ

SEQ ID NO: 1853 - protein, 6 aa, Artificial Sequence
  Description of Artificial Sequence: Synthetic peptide
QAQQQQ

SEQ ID NO: 1854 - protein, 6 aa, Artificial Sequence
  Description of Artificial Sequence: Synthetic peptide
QQAQQQ

SEQ ID NO: 1855 - protein, 6 aa, Artificial Sequence
  Description of Artificial Sequence: Synthetic peptide
QQQAQQ

SEQ ID NO: 1856 - protein, 6 aa, Artificial Sequence
  Description of Artificial Sequence: Synthetic peptide
QQQQAQ

SEQ ID NO: 1857 - protein, 6 aa, Artificial Sequence
  Description of Artificial Sequence: Synthetic peptide
QQQQAA

SEQ ID NO: 1858 - protein, 6 aa, Artificial Sequence
  Description of Artificial Sequence: Synthetic peptide
AAQQQQ

SEQ ID NO: 1859 - protein, 6 aa, Artificial Sequence
  Description of Artificial Sequence: Synthetic peptide
AQAQQQ

SEQ ID NO: 1860 - protein, 6 aa, Artificial Sequence
  Description of Artificial Sequence: Synthetic peptide
AQQAQQ

SEQ ID NO: 1861 - protein, 6 aa, Artificial Sequence
  Description of Artificial Sequence: Synthetic peptide
AQQQAQ

SEQ ID NO: 1862 - protein, 6 aa, Artificial Sequence
  Description of Artificial Sequence: Synthetic peptide
AQQQQA

SEQ ID NO: 1863 - protein, 6 aa, Artificial Sequence
  Description of Artificial Sequence: Synthetic peptide
QAAQQQ

SEQ ID NO: 1864 - protein, 6 aa, Artificial Sequence
  Description of Artificial Sequence: Synthetic peptide
QAQAQQ

SEQ ID NO: 1865 - protein, 6 aa, Artificial Sequence
  Description of Artificial Sequence: Synthetic peptide
QAQQAQ

SEQ ID NO: 1866 - protein, 6 aa, Artificial Sequence
  Description of Artificial Sequence: Synthetic peptide
QAQQQA

SEQ ID NO: 1867 - protein, 6 aa, Artificial Sequence
  Description of Artificial Sequence: Synthetic peptide
QQAAQQ

SEQ ID NO: 1868 - protein, 6 aa, Artificial Sequence
  Description of Artificial Sequence: Synthetic peptide
QQAQAQ

SEQ ID NO: 1869 - protein, 6 aa, Artificial Sequence
  Description of Artificial Sequence: Synthetic peptide
QQAQQA

SEQ ID NO: 1870 - protein, 6 aa, Artificial Sequence
  Description of Artificial Sequence: Synthetic peptide
QQQAAQ

SEQ ID NO: 1871 - protein, 6 aa, Artificial Sequence
  Description of Artificial Sequence: Synthetic peptide
QQQAQA

SEQ ID NO: 1872 - protein, 7 aa, Artificial Sequence
  Description of Artificial Sequence: Synthetic peptide
QQQQAAA

SEQ ID NO: 1873 - protein, 7 aa, Artificial Sequence
  Description of Artificial Sequence: Synthetic peptide
AAAQQQQ

SEQ ID NO: 1874 - protein, 7 aa, Artificial Sequence
  Description of Artificial Sequence: Synthetic peptide
AQAAQQQ

SEQ ID NO: 1875 - protein, 7 aa, Artificial Sequence
  Description of Artificial Sequence: Synthetic peptide
AQAQAQQ

SEQ ID NO: 1876 - protein, 7 aa, Artificial Sequence
  Description of Artificial Sequence: Synthetic peptide
AQAQQAQ

SEQ ID NO: 1877 - protein, 7 aa, Artificial Sequence
  Description of Artificial Sequence: Synthetic peptide
AQAQQQA

SEQ ID NO: 1878 - protein, 7 aa, Artificial Sequence
  Description of Artificial Sequence: Synthetic peptide
AQQAAQQ

SEQ ID NO: 1879 - protein, 7 aa, Artificial Sequence
  Description of Artificial Sequence: Synthetic peptide
AQQAQAQ

SEQ ID NO: 1880 - protein, 7 aa, Artificial Sequence
  Description of Artificial Sequence: Synthetic peptide
AQQAQQA

SEQ ID NO: 1881 - protein, 7 aa, Artificial Sequence
  Description of Artificial Sequence: Synthetic peptide
AQQQAQA

SEQ ID NO: 1882 - protein, 7 aa, Artificial Sequence
  Description of Artificial Sequence: Synthetic peptide
AQQQAAQ

SEQ ID NO: 1883 - protein, 7 aa, Artificial Sequence
  Description of Artificial Sequence: Synthetic peptide
AQQQQAA

SEQ ID NO: 1884 - protein, 7 aa, Artificial Sequence
  Description of Artificial Sequence: Synthetic peptide
AAQAQQQ

SEQ ID NO: 1885 - protein, 7 aa, Artificial Sequence
  Description of Artificial Sequence: Synthetic peptide
AAQQAQQ

SEQ ID NO: 1886 - protein, 7 aa, Artificial Sequence
  Description of Artificial Sequence: Synthetic peptide
AAQQQAQ

SEQ ID NO: 1887 - protein, 7 aa, Artificial Sequence
  Description of Artificial Sequence: Synthetic peptide
AAQQQQA

SEQ ID NO: 1888 - protein, 7 aa, Artificial Sequence
  Description of Artificial Sequence: Synthetic peptide
QAAAQQQ

SEQ ID NO: 1889 - protein, 7 aa, Artificial Sequence
  Description of Artificial Sequence: Synthetic peptide
QAAQAQQ

SEQ ID NO: 1890 - protein, 7 aa, Artificial Sequence
  Description of Artificial Sequence: Synthetic peptide
QAAQQAQ

SEQ ID NO: 1891 - protein, 7 aa, Artificial Sequence
  Description of Artificial Sequence: Synthetic peptide
QAAQQQA

SEQ ID NO: 1892 - protein, 7 aa, Artificial Sequence
  Description of Artificial Sequence: Synthetic peptide
QAQAAQQ

SEQ ID NO: 1893 - protein, 7 aa, Artificial Sequence
  Description of Artificial Sequence: Synthetic peptide
QAQQAAQ

SEQ ID NO: 1894 - protein, 7 aa, Artificial Sequence
  Description of Artificial Sequence: Synthetic peptide
QAQQQAA

SEQ ID NO: 1895 - protein, 7 aa, Artificial Sequence
  Description of Artificial Sequence: Synthetic peptide
QAQAQAQ

SEQ ID NO: 1896 - protein, 7 aa, Artificial Sequence
  Description of Artificial Sequence: Synthetic peptide
QAQAQQA

SEQ ID NO: 1897 - protein, 7 aa, Artificial Sequence
  Description of Artificial Sequence: Synthetic peptide
QAQQAQA

SEQ ID NO: 1898 - protein, 7 aa, Artificial Sequence
  Description of Artificial Sequence: Synthetic peptide
QQAAAQQ

SEQ ID NO: 1899 - protein, 7 aa, Artificial Sequence
  Description of Artificial Sequence: Synthetic peptide
QQAAQAQ

SEQ ID NO: 1900 - protein, 7 aa, Artificial Sequence
  Description of Artificial Sequence: Synthetic peptide
QQAAQQA

SEQ ID NO: 1901 - protein, 7 aa, Artificial Sequence
  Description of Artificial Sequence: Synthetic peptide
QQAQAAQ

SEQ ID NO: 1902 - protein, 7 aa, Artificial Sequence
  Description of Artificial Sequence: Synthetic peptide
QQAQAQA

SEQ ID NO: 1903 - protein, 7 aa, Artificial Sequence
  Description of Artificial Sequence: Synthetic peptide
QQAQQAA

SEQ ID NO: 1904 - protein, 7 aa, Artificial Sequence
  Description of Artificial Sequence: Synthetic peptide
QQQAAAQ

SEQ ID NO: 1905 - protein, 7 aa, Artificial Sequence
  Description of Artificial Sequence: Synthetic peptide
QQQAAQA

SEQ ID NO: 1906 - protein, 7 aa, Artificial Sequence
  Description of Artificial Sequence: Synthetic peptide
QQQAQAA

SEQ ID NO: 1907 - protein, 7 aa, Artificial Sequence
  Description of Artificial Sequence: Synthetic peptide
QQQQQAA

SEQ ID NO: 1908 - protein, 7 aa, Artificial Sequence
  Description of Artificial Sequence: Synthetic peptide
AAQQQQQ

SEQ ID NO: 1909 - protein, 7 aa, Artificial Sequence
  Description of Artificial Sequence: Synthetic peptide
AQAQQQQ

SEQ ID NO: 1910 - protein, 7 aa, Artificial Sequence
  Description of Artificial Sequence: Synthetic peptide
AQQAQQQ

SEQ ID NO: 1911 - protein, 7 aa, Artificial Sequence
  Description of Artificial Sequence: Synthetic peptide
AQQQAQQ

SEQ ID NO: 1912 - protein, 7 aa, Artificial Sequence
  Description of Artificial Sequence: Synthetic peptide
AQQQQAQ

SEQ ID NO: 1913 - protein, 7 aa, Artificial Sequence
  Description of Artificial Sequence: Synthetic peptide
AQQQQQA

SEQ ID NO: 1914 - protein, 7 aa, Artificial Sequence
  Description of Artificial Sequence: Synthetic peptide
QAAQQQQ

SEQ ID NO: 1915 - protein, 7 aa, Artificial Sequence
  Description of Artificial Sequence: Synthetic peptide
QAQAQQQ

SEQ ID NO: 1916 - protein, 7 aa, Artificial Sequence
  Description of Artificial Sequence: Synthetic peptide
QAQQAQQ

SEQ ID NO: 1917 - protein, 7 aa, Artificial Sequence
  Description of Artificial Sequence: Synthetic peptide
QAQQQAQ

SEQ ID NO: 1918 - protein, 7 aa, Artificial Sequence
  Description of Artificial Sequence: Synthetic peptide
QAQQQQA

SEQ ID NO: 1919 - protein, 7 aa, Artificial Sequence
  Description of Artificial Sequence: Synthetic peptide
QQAAQQQ

SEQ ID NO: 1920 - protein, 7 aa, Artificial Sequence
  Description of Artificial Sequence: Synthetic peptide
QQAQAQQ

SEQ ID NO: 1921 - protein, 7 aa, Artificial Sequence
  Description of Artificial Sequence: Synthetic peptide
QQAQQAQ

SEQ ID NO: 1922 - protein, 7 aa, Artificial Sequence
  Description of Artificial Sequence: Synthetic peptide
QQAQQQA

SEQ ID NO: 1923 - protein, 7 aa, Artificial Sequence
  Description of Artificial Sequence: Synthetic peptide
QQQAAQQ

SEQ ID NO: 1924 - protein, 7 aa, Artificial Sequence
  Description of Artificial Sequence: Synthetic peptide
QQQAQAQ

SEQ ID NO: 1925 - protein, 7 aa, Artificial Sequence
  Description of Artificial Sequence: Synthetic peptide
QQQAQQA

SEQ ID NO: 1926 - protein, 7 aa, Artificial Sequence
  Description of Artificial Sequence: Synthetic peptide
QQQQAAQ

SEQ ID NO: 1927 - protein, 7 aa, Artificial Sequence
  Description of Artificial Sequence: Synthetic peptide
QQQQAQA

SEQ ID NO: 1928 - protein, 7 aa, Artificial Sequence
  Description of Artificial Sequence: Synthetic peptide
QQQQQQA

SEQ ID NO: 1929 - protein, 7 aa, Artificial Sequence
  Description of Artificial Sequence: Synthetic peptide
AQQQQQQ

SEQ ID NO: 1930 - protein, 7 aa, Artificial Sequence
  Description of Artificial Sequence: Synthetic peptide
QAQQQQQ

SEQ ID NO: 1931 - protein, 7 aa, Artificial Sequence
  Description of Artificial Sequence: Synthetic peptide
QQAQQQQ

SEQ ID NO: 1932 - protein, 7 aa, Artificial Sequence
  Description of Artificial Sequence: Synthetic peptide
QQQAQQQ

SEQ ID NO: 1933 - protein, 7 aa, Artificial Sequence
  Description of Artificial Sequence: Synthetic peptide
QQQQAQQ

SEQ ID NO: 1934 - protein, 7 aa, Artificial Sequence
  Description of Artificial Sequence: Synthetic peptide
QQQQQAQ

SEQ ID NO: 1935 - protein, 4 aa, Artificial Sequence
  Description of Artificial Sequence: Synthetic peptide
QQQS

SEQ ID NO: 1936 - protein, 4 aa, Artificial Sequence
  Description of Artificial Sequence: Synthetic peptide
SQQQ

SEQ ID NO: 1937 - protein, 4 aa, Artificial Sequence
  Description of Artificial Sequence: Synthetic peptide
QSQQ

SEQ ID NO: 1938 - protein, 4 aa, Artificial Sequence
  Description of Artificial Sequence: Synthetic peptide
QQSQ

SEQ ID NO: 1939 - protein, 5 aa, Artificial Sequence
  Description of Artificial Sequence: Synthetic peptide
QQQQS

SEQ ID NO: 1940 - protein, 5 aa, Artificial Sequence
  Description of Artificial Sequence: Synthetic peptide
SQQQQ

SEQ ID NO: 1941 - protein, 5 aa, Artificial Sequence
  Description of Artificial Sequence: Synthetic peptide
QSQQQ

SEQ ID NO: 1942 - protein, 5 aa, Artificial Sequence
  Description of Artificial Sequence: Synthetic peptide
QQSQQ

SEQ ID NO: 1943 - protein, 5 aa, Artificial Sequence
  Description of Artificial Sequence: Synthetic peptide
QQQSQ

SEQ ID NO: 1944 - protein, 5 aa, Artificial Sequence
  Description of Artificial Sequence: Synthetic peptide
QQQSS

SEQ ID NO: 1945 - protein, 5 aa, Artificial Sequence
  Description of Artificial Sequence: Synthetic peptide
SSQQQ

SEQ ID NO: 1946 - protein, 5 aa, Artificial Sequence
  Description of Artificial Sequence: Synthetic peptide
SQSQQ

SEQ ID NO: 1947 - protein, 5 aa, Artificial Sequence
  Description of Artificial Sequence: Synthetic peptide
SQQSQ

SEQ ID NO: 1948 - protein, 5 aa, Artificial Sequence
  Description of Artificial Sequence: Synthetic peptide
SQQQS

SEQ ID NO: 1949 - protein, 5 aa, Artificial Sequence
  Description of Artificial Sequence: Synthetic peptide
QSSQQ

SEQ ID NO: 1950 - protein, 5 aa, Artificial Sequence
  Description of Artificial Sequence: Synthetic peptide
QSQSQ

SEQ ID NO: 1951 - protein, 5 aa, Artificial Sequence
  Description of Artificial Sequence: Synthetic peptide
QSQQS

SEQ ID NO: 1952 - protein, 5 aa, Artificial Sequence
  Description of Artificial Sequence: Synthetic peptide
QQSSQ

SEQ ID NO: 1953 - protein, 5 aa, Artificial Sequence
  Description of Artificial Sequence: Synthetic peptide
QQSQS

SEQ ID NO: 1954 - protein, 6 aa, Artificial Sequence
  Description of Artificial Sequence: Synthetic peptide
QQQQQS

SEQ ID NO: 1955 - protein, 6 aa, Artificial Sequence
  Description of Artificial Sequence: Synthetic peptide
SQQQQQ

SEQ ID NO: 1956 - protein, 6 aa, Artificial Sequence
  Description of Artificial Sequence: Synthetic peptide
QSQQQQ

SEQ ID NO: 1957 - protein, 6 aa, Artificial Sequence
  Description of Artificial Sequence: Synthetic peptide
QQSQQQ

SEQ ID NO: 1958 - protein, 6 aa, Artificial Sequence
  Description of Artificial Sequence: Synthetic peptide
QQQSQQ

SEQ ID NO: 1959 - protein, 6 aa, Artificial Sequence
  Description of Artificial Sequence: Synthetic peptide
QQQQSQ

SEQ ID NO: 1960 - protein, 6 aa, Artificial Sequence
  Description of Artificial Sequence: Synthetic peptide
QQQQSS

SEQ ID NO: 1961 - protein, 6 aa, Artificial Sequence
  Description of Artificial Sequence: Synthetic peptide
SSQQQQ

SEQ ID NO: 1962 - protein, 6 aa, Artificial Sequence
  Description of Artificial Sequence: Synthetic peptide
SQSQQQ

SEQ ID NO: 1963 - protein, 6 aa, Artificial Sequence
  Description of Artificial Sequence: Synthetic peptide
SQQSQQ

SEQ ID NO: 1964 - protein, 6 aa, Artificial Sequence
  Description of Artificial Sequence: Synthetic peptide
SQQQSQ

SEQ ID NO: 1965 - protein, 6 aa, Artificial Sequence
  Description of Artificial Sequence: Synthetic peptide
SQQQQS

SEQ ID NO: 1966 - protein, 6 aa, Artificial Sequence
  Description of Artificial Sequence: Synthetic peptide
QSSQQQ

SEQ ID NO: 1967 - protein, 6 aa, Artificial Sequence
  Description of Artificial Sequence: Synthetic peptide
QSQSQQ

SEQ ID NO: 1968 - protein, 6 aa, Artificial Sequence
  Description of Artificial Sequence: Synthetic peptide
QSQQSQ

SEQ ID NO: 1969 - protein, 6 aa, Artificial Sequence
  Description of Artificial Sequence: Synthetic peptide
QSQQQS

SEQ ID NO: 1970 - protein, 6 aa, Artificial Sequence
  Description of Artificial Sequence: Synthetic peptide
QQSSQQ

SEQ ID NO: 1971 - protein, 6 aa, Artificial Sequence
  Description of Artificial Sequence: Synthetic peptide
QQSQSQ

SEQ ID NO: 1972 - protein, 6 aa, Artificial Sequence
  Description of Artificial Sequence: Synthetic peptide
QQSQQS

SEQ ID NO: 1973 - protein, 6 aa, Artificial Sequence
  Description of Artificial Sequence: Synthetic peptide
QQQSSQ

SEQ ID NO: 1974 - protein, 6 aa, Artificial Sequence
  Description of Artificial Sequence: Synthetic peptide
QQQSQS

SEQ ID NO: 1975 - protein, 7 aa, Artificial Sequence
  Description of Artificial Sequence: Synthetic peptide
QQQQSSS

SEQ ID NO: 1976 - protein, 7 aa, Artificial Sequence
  Description of Artificial Sequence: Synthetic peptide
SSSQQQQ

SEQ ID NO: 1977 - protein, 7 aa, Artificial Sequence
  Description of Artificial Sequence: Synthetic peptide
SQSSQQQ

SEQ ID NO: 1978 - protein, 7 aa, Artificial Sequence
  Description of Artificial Sequence: Synthetic peptide
SQSQSQQ

SEQ ID NO: 1979 - protein, 7 aa, Artificial Sequence
  Description of Artificial Sequence: Synthetic peptide
SQSQQSQ

SEQ ID NO: 1980 - protein, 7 aa, Artificial Sequence
  Description of Artificial Sequence: Synthetic peptide
SQSQQQS

SEQ ID NO: 1981 - protein, 7 aa, Artificial Sequence
  Description of Artificial Sequence: Synthetic peptide
SQQSSQQ

SEQ ID NO: 1982 - protein, 7 aa, Artificial Sequence
  Description of Artificial Sequence: Synthetic peptide
SQQSQSQ

SEQ ID NO: 1983 - protein, 7 aa, Artificial Sequence
  Description of Artificial Sequence: Synthetic peptide
SQQSQQS

SEQ ID NO: 1984 - protein, 7 aa, Artificial Sequence
  Description of Artificial Sequence: Synthetic peptide
SQQQSQS

SEQ ID NO: 1985 - protein, 7 aa, Artificial Sequence
  Description of Artificial Sequence: Synthetic peptide
SQQQSSQ

SEQ ID NO: 1986 - protein, 7 aa, Artificial Sequence
  Description of Artificial Sequence: Synthetic peptide
SQQQQSS

SEQ ID NO: 1987 - protein, 7 aa, Artificial Sequence
  Description of Artificial Sequence: Synthetic peptide
SSQSQQQ

SEQ ID NO: 1988 - protein, 7 aa, Artificial Sequence
  Description of Artificial Sequence: Synthetic peptide
SSQQSQQ

SEQ ID NO: 1989 - protein, 7 aa, Artificial Sequence
  Description of Artificial Sequence: Synthetic peptide
SSQQQSQ

SEQ ID NO: 1990 - protein, 7 aa, Artificial Sequence
  Description of Artificial Sequence: Synthetic peptide
SSQQQQS

SEQ ID NO: 1991 - protein, 7 aa, Artificial Sequence
  Description of Artificial Sequence: Synthetic peptide
QSSSQQQ

SEQ ID NO: 1992 - protein, 7 aa, Artificial Sequence
  Description of Artificial Sequence: Synthetic peptide
QSSQSQQ

SEQ ID NO: 1993 - protein, 7 aa, Artificial Sequence
  Description of Artificial Sequence: Synthetic peptide
QSSQQSQ

SEQ ID NO: 1994 - protein, 7 aa, Artificial Sequence
  Description of Artificial Sequence: Synthetic peptide
QSSQQQS

SEQ ID NO: 1995 - protein, 7 aa, Artificial Sequence
  Description of Artificial Sequence: Synthetic peptide
QSQSSQQ

SEQ ID NO: 1996 - protein, 7 aa, Artificial Sequence
  Description of Artificial Sequence: Synthetic peptide
QSQQSSQ

SEQ ID NO: 1997 - protein, 7 aa, Artificial Sequence
  Description of Artificial Sequence: Synthetic peptide
QSQQQSS

SEQ ID NO: 1998 - protein, 7 aa, Artificial Sequence
  Description of Artificial Sequence: Synthetic peptide
QSQSQSQ

SEQ ID NO: 1999 - protein, 7 aa, Artificial Sequence
  Description of Artificial Sequence: Synthetic peptide
QSQSQQS

SEQ ID NO: 2000 - protein, 7 aa, Artificial Sequence
  Description of Artificial Sequence: Synthetic peptide
QSQQSQS

SEQ ID NO: 2001 - protein, 7 aa, Artificial Sequence
  Description of Artificial Sequence: Synthetic peptide
QQSSSQQ

SEQ ID NO: 2002 - protein, 7 aa, Artificial Sequence
  Description of Artificial Sequence: Synthetic peptide
QQSSQSQ

SEQ ID NO: 2003 - protein, 7 aa, Artificial Sequence
  Description of Artificial Sequence: Synthetic peptide
QQSSQQS

SEQ ID NO: 2004 - protein, 7 aa, Artificial Sequence
  Description of Artificial Sequence: Synthetic peptide
QQSQSSQ

SEQ ID NO: 2005 - protein, 7 aa, Artificial Sequence
  Description of Artificial Sequence: Synthetic peptide
QQSQSQS

SEQ ID NO: 2006 - protein, 7 aa, Artificial Sequence
  Description of Artificial Sequence: Synthetic peptide
QQSQQSS

SEQ ID NO: 2007 - protein, 7 aa, Artificial Sequence
  Description of Artificial Sequence: Synthetic peptide
QQQSSSQ

SEQ ID NO: 2008 - protein, 7 aa, Artificial Sequence
  Description of Artificial Sequence: Synthetic peptide
QQQSSQS

SEQ ID NO: 2009 - protein, 7 aa, Artificial Sequence
  Description of Artificial Sequence: Synthetic peptide
QQQSQSS

SEQ ID NO: 2010 - protein, 7 aa, Artificial Sequence
  Description of Artificial Sequence: Synthetic peptide
QQQQQSS

SEQ ID NO: 2011 - protein, 7 aa, Artificial Sequence
  Description of Artificial Sequence: Synthetic peptide
SSQQQQQ

SEQ ID NO: 2012 - protein, 7 aa, Artificial Sequence
  Description of Artificial Sequence: Synthetic peptide
SQSQQQQ

SEQ ID NO: 2013 - protein, 7 aa, Artificial Sequence
  Description of Artificial Sequence: Synthetic peptide
SQQSQQQ

SEQ ID NO: 2014 - protein, 7 aa, Artificial Sequence
  Description of Artificial Sequence: Synthetic peptide
SQQQSQQ

SEQ ID NO: 2015 - protein, 7 aa, Artificial Sequence
  Description of Artificial Sequence: Synthetic peptide
SQQQQSQ

SEQ ID NO: 2016 - protein, 7 aa, Artificial Sequence
  Description of Artificial Sequence: Synthetic peptide
SQQQQQS

SEQ ID NO: 2017 - protein, 7 aa, Artificial Sequence
  Description of Artificial Sequence: Synthetic peptide
QSSQQQQ

SEQ ID NO: 2018 - protein, 7 aa, Artificial Sequence
  Description of Artificial Sequence: Synthetic peptide
QSQSQQQ

SEQ ID NO: 2019 - protein, 7 aa, Artificial Sequence
  Description of Artificial Sequence: Synthetic peptide
QSQQSQQ

SEQ ID NO: 2020 - protein, 7 aa, Artificial Sequence
  Description of Artificial Sequence: Synthetic peptide
QSQQQSQ

SEQ ID NO: 2021 - protein, 7 aa, Artificial Sequence
  Description of Artificial Sequence: Synthetic peptide
QSQQQQS

SEQ ID NO: 2022 - protein, 7 aa, Artificial Sequence
  Description of Artificial Sequence: Synthetic peptide
QQSSQQQ

SEQ ID NO: 2023 - protein, 7 aa, Artificial Sequence
  Description of Artificial Sequence: Synthetic peptide
QQSQSQQ

SEQ ID NO: 2024 - protein, 7 aa, Artificial Sequence
  Description of Artificial Sequence: Synthetic peptide
QQSQQSQ

SEQ ID NO: 2025 - protein, 7 aa, Artificial Sequence
  Description of Artificial Sequence: Synthetic peptide
QQSQQQS

SEQ ID NO: 2026 - protein, 7 aa, Artificial Sequence
  Description of Artificial Sequence: Synthetic peptide
QQQSSQQ

SEQ ID NO: 2027 - protein, 7 aa, Artificial Sequence
  Description of Artificial Sequence: Synthetic peptide
QQQSQSQ

SEQ ID NO: 2028 - protein, 7 aa, Artificial Sequence
  Description of Artificial Sequence: Synthetic peptide
QQQSQQS

SEQ ID NO: 2029 - protein, 7 aa, Artificial Sequence
  Description of Artificial Sequence: Synthetic peptide
QQQQSSQ

SEQ ID NO: 2030 - protein, 7 aa, Artificial Sequence
  Description of Artificial Sequence: Synthetic peptide
QQQQSQS

SEQ ID NO: 2031 - protein, 7 aa, Artificial Sequence
  Description of Artificial Sequence: Synthetic peptide
QQQQQQS

SEQ ID NO: 2032 - protein, 7 aa, Artificial Sequence
  Description of Artificial Sequence: Synthetic peptide
SQQQQQQ

SEQ ID NO: 2033 - protein, 7 aa, Artificial Sequence
  Description of Artificial Sequence: Synthetic peptide
QSQQQQQ

SEQ ID NO: 2034 - protein, 7 aa, Artificial Sequence
  Description of Artificial Sequence: Synthetic peptide
QQSQQQQ

SEQ ID NO: 2035 - protein, 7 aa, Artificial Sequence
  Description of Artificial Sequence: Synthetic peptide
QQQSQQQ

SEQ ID NO: 2036 - protein, 7 aa, Artificial Sequence
  Description of Artificial Sequence: Synthetic peptide
QQQQSQQ

SEQ ID NO: 2037 - protein, 7 aa, Artificial Sequence
  Description of Artificial Sequence: Synthetic peptide
QQQQQSQ

SEQ ID NO: 2038 - protein, 4 aa, Artificial Sequence
  Description of Artificial Sequence: Synthetic peptide
QQQE

SEQ ID NO: 2039 - protein, 4 aa, Artificial Sequence
  Description of Artificial Sequence: Synthetic peptide
EQQQ

SEQ ID NO: 2040 - protein, 4 aa, Artificial Sequence
  Description of Artificial Sequence: Synthetic peptide
QEQQ

SEQ ID NO: 2041 - protein, 4 aa, Artificial Sequence
  Description of Artificial Sequence: Synthetic peptide
QQEQ

SEQ ID NO: 2042 - protein, 5 aa, Artificial Sequence
  Description of Artificial Sequence: Synthetic peptide
QQQQE

SEQ ID NO: 2043 - protein, 5 aa, Artificial Sequence
  Description of Artificial Sequence: Synthetic peptide
EQQQQ

SEQ ID NO: 2044 - protein, 5 aa, Artificial Sequence
  Description of Artificial Sequence: Synthetic peptide
QEQQQ

SEQ ID NO: 2045 - protein, 5 aa, Artificial Sequence
  Description of Artificial Sequence: Synthetic peptide
QQEQQ

SEQ ID NO: 2046 - protein, 5 aa, Artificial Sequence
  Description of Artificial Sequence: Synthetic peptide
QQQEQ

SEQ ID NO: 2047 - protein, 5 aa, Artificial Sequence
  Description of Artificial Sequence: Synthetic peptide
QQQEE

SEQ ID NO: 2048 - protein, 5 aa, Artificial Sequence
  Description of Artificial Sequence: Synthetic peptide
EEQQQ

SEQ ID NO: 2049 - protein, 5 aa, Artificial Sequence
  Description of Artificial Sequence: Synthetic peptide
EQEQQ

SEQ ID NO: 2050 - protein, 5 aa, Artificial Sequence
  Description of Artificial Sequence: Synthetic peptide
EQQEQ

SEQ ID NO: 2051 - protein, 5 aa, Artificial Sequence
  Description of Artificial Sequence: Synthetic peptide
EQQQE

SEQ ID NO: 2052 - protein, 5 aa, Artificial Sequence
  Description of Artificial Sequence: Synthetic peptide
QEEQQ

SEQ ID NO: 2053 - protein, 5 aa, Artificial Sequence
  Description of Artificial Sequence: Synthetic peptide
QEQEQ

SEQ ID NO: 2054 - protein, 5 aa, Artificial Sequence
  Description of Artificial Sequence: Synthetic peptide
QEQQE

SEQ ID NO: 2055 - protein, 5 aa, Artificial Sequence
  Description of Artificial Sequence: Synthetic peptide
QQEEQ

SEQ ID NO: 2056 - protein, 5 aa, Artificial Sequence
  Description of Artificial Sequence: Synthetic peptide
QQEQE

SEQ ID NO: 2057 - protein, 6 aa, Artificial Sequence
  Description of Artificial Sequence: Synthetic peptide
QQQQQE

SEQ ID NO: 2058 - protein, 6 aa, Artificial Sequence
  Description of Artificial Sequence: Synthetic peptide
EQQQQQ

SEQ ID NO: 2059 - protein, 6 aa, Artificial Sequence
  Description of Artificial Sequence: Synthetic peptide
QEQQQQ

SEQ ID NO: 2060 - protein, 6 aa, Artificial Sequence
  Description of Artificial Sequence: Synthetic peptide
QQEQQQ

SEQ ID NO: 2061 - protein, 6 aa, Artificial Sequence
  Description of Artificial Sequence: Synthetic peptide
QQQEQQ

SEQ ID NO: 2062 - protein, 6 aa, Artificial Sequence
  Description of Artificial Sequence: Synthetic peptide
QQQQEQ

SEQ ID NO: 2063 - protein, 6 aa, Artificial Sequence
  Description of Artificial Sequence: Synthetic peptide
QQQQEE

SEQ ID NO: 2064 - protein, 6 aa, Artificial Sequence
  Description of Artificial Sequence: Synthetic peptide
EEQQQQ

SEQ ID NO: 2065 - protein, 6 aa, Artificial Sequence
  Description of Artificial Sequence: Synthetic peptide
EQEQQQ

SEQ ID NO: 2066 - protein, 6 aa, Artificial Sequence
  Description of Artificial Sequence: Synthetic peptide
EQQEQQ

SEQ ID NO: 2067 - protein, 6 aa, Artificial Sequence
  Description of Artificial Sequence: Synthetic peptide
EQQQEQ

SEQ ID NO: 2068 - protein, 6 aa, Artificial Sequence
  Description of Artificial Sequence: Synthetic peptide
EQQQQE

SEQ ID NO: 2069 - protein, 6 aa, Artificial Sequence
  Description of Artificial Sequence: Synthetic peptide
QEEQQQ

SEQ ID NO: 2070 - protein, 6 aa, Artificial Sequence
  Description of Artificial Sequence: Synthetic peptide
QEQEQQ

SEQ ID NO: 2071 - protein, 6 aa, Artificial Sequence
  Description of Artificial Sequence: Synthetic peptide
QEQQEQ

SEQ ID NO: 2072 - protein, 6 aa, Artificial Sequence
  Description of Artificial Sequence: Synthetic peptide
QEQQQE

SEQ ID NO: 2073 - protein, 6 aa, Artificial Sequence
  Description of Artificial Sequence: Synthetic peptide
QQEEQQ

SEQ ID NO: 2074 - protein, 6 aa, Artificial Sequence
  Description of Artificial Sequence: Synthetic peptide
QQEQEQ

SEQ ID NO: 2075 - protein, 6 aa, Artificial Sequence
  Description of Artificial Sequence: Synthetic peptide
QQEQQE

SEQ ID NO: 2076 - protein, 6 aa, Artificial Sequence
  Description of Artificial Sequence: Synthetic peptide
QQQEEQ

SEQ ID NO: 2077 - protein, 6 aa, Artificial Sequence
  Description of Artificial Sequence: Synthetic peptide
QQQEQE

SEQ ID NO: 2078 - protein, 7 aa, Artificial Sequence
  Description of Artificial Sequence: Synthetic peptide
QQQQEEE

SEQ ID NO: 2079 - protein, 7 aa, Artificial Sequence
  Description of Artificial Sequence: Synthetic peptide
EEEQQQQ

SEQ ID NO: 2080 - protein, 7 aa, Artificial Sequence
  Description of Artificial Sequence: Synthetic peptide
EQEEQQQ

SEQ ID NO: 2081 - protein, 7 aa, Artificial Sequence
  Description of Artificial Sequence: Synthetic peptide
EQEQEQQ

SEQ ID NO: 2082 - protein, 7 aa, Artificial Sequence
  Description of Artificial Sequence: Synthetic peptide
EQEQQEQ

SEQ ID NO: 2083 - protein, 7 aa, Artificial Sequence
  Description of Artificial Sequence: Synthetic peptide
EQEQQQE

SEQ ID NO: 2084 - protein, 7 aa, Artificial Sequence
  Description of Artificial Sequence: Synthetic peptide
EQQEEQQ

SEQ ID NO: 2085 - protein, 7 aa, Artificial Sequence
  Description of Artificial Sequence: Synthetic peptide
EQQEQEQ

SEQ ID NO: 2086 - protein, 7 aa, Artificial Sequence
  Description of Artificial Sequence: Synthetic peptide
EQQEQQE

SEQ ID NO: 2087 - protein, 7 aa, Artificial Sequence
  Description of Artificial Sequence: Synthetic peptide
EQQQEQE

SEQ ID NO: 2088 - protein, 7 aa, Artificial Sequence
  Description of Artificial Sequence: Synthetic peptide
EQQQEEQ

SEQ ID NO: 2089 - protein, 7 aa, Artificial Sequence
  Description of Artificial Sequence: Synthetic peptide
EQQQQEE

SEQ ID NO: 2090 - protein, 7 aa, Artificial Sequence
  Description of Artificial Sequence: Synthetic peptide
EEQEQQQ

SEQ ID NO: 2091 - protein, 7 aa, Artificial Sequence
  Description of Artificial Sequence: Synthetic peptide
EEQQEQQ

SEQ ID NO: 2092 - protein, 7 aa, Artificial Sequence
  Description of Artificial Sequence: Synthetic peptide
EEQQQEQ

SEQ ID NO: 2093 - protein, 7 aa, Artificial Sequence
  Description of Artificial Sequence: Synthetic peptide
EEQQQQE

SEQ ID NO: 2094 - protein, 7 aa, Artificial Sequence
  Description of Artificial Sequence: Synthetic peptide
QEEEQQQ

SEQ ID NO: 2095 - protein, 7 aa, Artificial Sequence
  Description of Artificial Sequence: Synthetic peptide
QEEQEQQ

SEQ ID NO: 2096 - protein, 7 aa, Artificial Sequence
  Description of Artificial Sequence: Synthetic peptide
QEEQQEQ

SEQ ID NO: 2097 - protein, 7 aa, Artificial Sequence
  Description of Artificial Sequence: Synthetic peptide
QEEQQQE

SEQ ID NO: 2098 - protein, 7 aa, Artificial Sequence
  Description of Artificial Sequence: Synthetic peptide
QEQEEQQ

SEQ ID NO: 2099 - protein, 7 aa, Artificial Sequence
  Description of Artificial Sequence: Synthetic peptide
QEQQEEQ

SEQ ID NO: 2100 - protein, 7 aa, Artificial Sequence
  Description of Artificial Sequence: Synthetic peptide
QEQQQEE

SEQ ID NO: 2101 - protein, 7 aa, Artificial Sequence
  Description of Artificial Sequence: Synthetic peptide
QEQEQEQ

SEQ ID NO: 2102 - protein, 7 aa, Artificial Sequence
  Description of Artificial Sequence: Synthetic peptide
QEQEQQE

SEQ ID NO: 2103 - protein, 7 aa, Artificial Sequence
  Description of Artificial Sequence: Synthetic peptide
QEQQEQE

SEQ ID NO: 2104 - protein, 7 aa, Artificial Sequence
  Description of Artificial Sequence: Synthetic peptide
QQEEEQQ

SEQ ID NO: 2105 - protein, 7 aa, Artificial Sequence
  Description of Artificial Sequence: Synthetic peptide
QQEEQEQ

SEQ ID NO: 2106 - protein, 7 aa, Artificial Sequence
  Description of Artificial Sequence: Synthetic peptide
QQEEQQE

SEQ ID NO: 2107 - protein, 7 aa, Artificial Sequence
  Description of Artificial Sequence: Synthetic peptide
QQEQEEQ

SEQ ID NO: 2108 - protein, 7 aa, Artificial Sequence
  Description of Artificial Sequence: Synthetic peptide
QQEQEQE

SEQ ID NO: 2109 - protein, 7 aa, Artificial Sequence
  Description of Artificial Sequence: Synthetic peptide
QQEQQEE

SEQ ID NO: 2110 - protein, 7 aa, Artificial Sequence
  Description of Artificial Sequence: Synthetic peptide
QQQEEEQ

SEQ ID NO: 2111 - protein, 7 aa, Artificial Sequence
  Description of Artificial Sequence: Synthetic peptide
QQQEEQE

SEQ ID NO: 2112 - protein, 7 aa, Artificial Sequence
  Description of Artificial Sequence: Synthetic peptide
QQQEQEE

SEQ ID NO: 2113 - protein, 7 aa, Artificial Sequence
  Description of Artificial Sequence: Synthetic peptide
QQQQQEE

SEQ ID NO: 2114 - protein, 7 aa, Artificial Sequence
  Description of Artificial Sequence: Synthetic peptide
EEQQQQQ

SEQ ID NO: 2115 - protein, 7 aa, Artificial Sequence
  Description of Artificial Sequence: Synthetic peptide
EQEQQQQ

SEQ ID NO: 2116 - protein, 7 aa, Artificial Sequence
  Description of Artificial Sequence: Synthetic peptide
EQQEQQQ

SEQ ID NO: 2117 - protein, 7 aa, Artificial Sequence
  Description of Artificial Sequence: Synthetic peptide
EQQQEQQ

SEQ ID NO: 2118 - protein, 7 aa, Artificial Sequence
  Description of Artificial Sequence: Synthetic peptide
EQQQQEQ

SEQ ID NO: 2119 - protein, 7 aa, Artificial Sequence
  Description of Artificial Sequence: Synthetic peptide
EQQQQQE

SEQ ID NO: 2120 - protein, 7 aa, Artificial Sequence
  Description of Artificial Sequence: Synthetic peptide
QEEQQQQ

SEQ ID NO: 2121 - protein, 7 aa, Artificial Sequence
  Description of Artificial Sequence: Synthetic peptide
QEQEQQQ

SEQ ID NO: 2122 - protein, 7 aa, Artificial Sequence
  Description of Artificial Sequence: Synthetic peptide
QEQQEQQ

SEQ ID NO: 2123 - protein, 7 aa, Artificial Sequence
  Description of Artificial Sequence: Synthetic peptide
QEQQQEQ

SEQ ID NO: 2124 - protein, 7 aa, Artificial Sequence
  Description of Artificial Sequence: Synthetic peptide
QEQQQQE

SEQ ID NO: 2125 - protein, 7 aa, Artificial Sequence
  Description of Artificial Sequence: Synthetic peptide
QQEEQQQ

SEQ ID NO: 2126 - protein, 7 aa, Artificial Sequence
  Description of Artificial Sequence: Synthetic peptide
QQEQEQQ

SEQ ID NO: 2127 - protein, 7 aa, Artificial Sequence
  Description of Artificial Sequence: Synthetic peptide
QQEQQEQ

SEQ ID NO: 2128 - protein, 7 aa, Artificial Sequence
  Description of Artificial Sequence: Synthetic peptide
QQEQQQE

SEQ ID NO: 2129 - protein, 7 aa, Artificial Sequence
  Description of Artificial Sequence: Synthetic peptide
QQQEEQQ

SEQ ID NO: 2130 - protein, 7 aa, Artificial Sequence
  Description of Artificial Sequence: Synthetic peptide
QQQEQEQ

SEQ ID NO: 2131 - protein, 7 aa, Artificial Sequence
  Description of Artificial Sequence: Synthetic peptide
QQQEQQE

SEQ ID NO: 2132 - protein, 7 aa, Artificial Sequence
  Description of Artificial Sequence: Synthetic peptide
QQQQEEQ

SEQ ID NO: 2133 - protein, 7 aa, Artificial Sequence
  Description of Artificial Sequence: Synthetic peptide
QQQQEQE

SEQ ID NO: 2134 - protein, 7 aa, Artificial Sequence
  Description of Artificial Sequence: Synthetic peptide
QQQQQQE

SEQ ID NO: 2135 - protein, 7 aa, Artificial Sequence
  Description of Artificial Sequence: Synthetic peptide
EQQQQQQ

SEQ ID NO: 2136 - protein, 7 aa, Artificial Sequence
  Description of Artificial Sequence: Synthetic peptide
QEQQQQQ

SEQ ID NO: 2137 - protein, 7 aa, Artificial Sequence
  Description of Artificial Sequence: Synthetic peptide
QQEQQQQ

SEQ ID NO: 2138 - protein, 7 aa, Artificial Sequence
  Description of Artificial Sequence: Synthetic peptide
QQQEQQQ

SEQ ID NO: 2139 - protein, 7 aa, Artificial Sequence
  Description of Artificial Sequence: Synthetic peptide
QQQQEQQ

SEQ ID NO: 2140 - protein, 7 aa, Artificial Sequence
  Description of Artificial Sequence: Synthetic peptide
QQQQQEQ

SEQ ID NO: 2141 - protein, 4 aa, Artificial Sequence
  Description of Artificial Sequence: Synthetic peptide
QQQH

SEQ ID NO: 2142 - protein, 4 aa, Artificial Sequence
  Description of Artificial Sequence: Synthetic peptide
HQQQ

SEQ ID NO: 2143 - protein, 4 aa, Artificial Sequence
  Description of Artificial Sequence: Synthetic peptide
QHQQ

SEQ ID NO: 2144 - protein, 4 aa, Artificial Sequence
  Description of Artificial Sequence: Synthetic peptide
QQHQ

SEQ ID NO: 2145 - protein, 5 aa, Artificial Sequence
  Description of Artificial Sequence: Synthetic peptide
QQQQH

SEQ ID NO: 2146 - protein, 5 aa, Artificial Sequence
  Description of Artificial Sequence: Synthetic peptide
HQQQQ

SEQ ID NO: 2147 - protein, 5 aa, Artificial Sequence
  Description of Artificial Sequence: Synthetic peptide
QHQQQ

SEQ ID NO: 2148 - protein, 5 aa, Artificial Sequence
  Description of Artificial Sequence: Synthetic peptide
QQHQQ

SEQ ID NO: 2149 - protein, 5 aa, Artificial Sequence
  Description of Artificial Sequence: Synthetic peptide
QQQHQ

SEQ ID NO: 2150 - protein, 5 aa, Artificial Sequence
  Description of Artificial Sequence: Synthetic peptide
QQQHH

SEQ ID NO: 2151 - protein, 5 aa, Artificial Sequence
  Description of Artificial Sequence: Synthetic peptide
HHQQQ

SEQ ID NO: 2152 - protein, 5 aa, Artificial Sequence
  Description of Artificial Sequence: Synthetic peptide
HQHQQ

SEQ ID NO: 2153 - protein, 5 aa, Artificial Sequence
  Description of Artificial Sequence: Synthetic peptide
HQQHQ

SEQ ID NO: 2154 - protein, 5 aa, Artificial Sequence
  Description of Artificial Sequence: Synthetic peptide
HQQQH

SEQ ID NO: 2155 - protein, 5 aa, Artificial Sequence
  Description of Artificial Sequence: Synthetic peptide
QHHQQ

SEQ ID NO: 2156 - protein, 5 aa, Artificial Sequence
  Description of Artificial Sequence: Synthetic peptide
QHQHQ

SEQ ID NO: 2157 - protein, 5 aa, Artificial Sequence
  Description of Artificial Sequence: Synthetic peptide
QHQQH

SEQ ID NO: 2158 - protein, 5 aa, Artificial Sequence
  Description of Artificial Sequence: Synthetic peptide
QQHHQ

SEQ ID NO: 2159 - protein, 5 aa, Artificial Sequence
  Description of Artificial Sequence: Synthetic peptide
QQHQH

SEQ ID NO: 2160 - protein, 6 aa, Artificial Sequence
  Description of Artificial Sequence: Synthetic peptide
QQQQQH

SEQ ID NO: 2161 - protein, 6 aa, Artificial Sequence
  Description of Artificial Sequence: Synthetic peptide
HQQQQQ

SEQ ID NO: 2162 - protein, 6 aa, Artificial Sequence
  Description of Artificial Sequence: Synthetic peptide
QHQQQQ

SEQ ID NO: 2163 - protein, 6 aa, Artificial Sequence
  Description of Artificial Sequence: Synthetic peptide
QQHQQQ

SEQ ID NO: 2164 - protein, 6 aa, Artificial Sequence
  Description of Artificial Sequence: Synthetic peptide
QQQHQQ

SEQ ID NO: 2165 - protein, 6 aa, Artificial Sequence
  Description of Artificial Sequence: Synthetic peptide
QQQQHQ

SEQ ID NO: 2166 - protein, 6 aa, Artificial Sequence
  Description of Artificial Sequence: Synthetic peptide
QQQQHH

SEQ ID NO: 2167 - protein, 6 aa, Artificial Sequence
  Description of Artificial Sequence: Synthetic peptide
HHQQQQ

SEQ ID NO: 2168 - protein, 6 aa, Artificial Sequence
  Description of Artificial Sequence: Synthetic peptide
HQHQQQ

SEQ ID NO: 2169 - protein, 6 aa, Artificial Sequence
  Description of Artificial Sequence: Synthetic peptide
HQQHQQ

SEQ ID NO: 2170 - protein, 6 aa, Artificial Sequence
  Description of Artificial Sequence: Synthetic peptide
HQQQHQ

SEQ ID NO: 2171 - protein, 6 aa, Artificial Sequence
  Description of Artificial Sequence: Synthetic peptide
HQQQQH

SEQ ID NO: 2172 - protein, 6 aa, Artificial Sequence
  Description of Artificial Sequence: Synthetic peptide
QHHQQQ

SEQ ID NO: 2173 - protein, 6 aa, Artificial Sequence
  Description of Artificial Sequence: Synthetic peptide
QHQHQQ

SEQ ID NO: 2174 - protein, 6 aa, Artificial Sequence
  Description of Artificial Sequence: Synthetic peptide
QHQQHQ

SEQ ID NO: 2175 - protein, 6 aa, Artificial Sequence
  Description of Artificial Sequence: Synthetic peptide
QHQQQH

SEQ ID NO: 2176 - protein, 6 aa, Artificial Sequence
  Description of Artificial Sequence: Synthetic peptide
QQHHQQ

SEQ ID NO: 2177 - protein, 6 aa, Artificial Sequence
  Description of Artificial Sequence: Synthetic peptide
QQHQHQ

SEQ ID NO: 2178 - protein, 6 aa, Artificial Sequence
  Description of Artificial Sequence: Synthetic peptide
QQHQQH

SEQ ID NO: 2179 - protein, 6 aa, Artificial Sequence
  Description of Artificial Sequence: Synthetic peptide
QQQHHQ

SEQ ID NO: 2180 - protein, 6 aa, Artificial Sequence
  Description of Artificial Sequence: Synthetic peptide
QQQHQH

SEQ ID NO: 2181 - protein, 7 aa, Artificial Sequence
  Description of Artificial Sequence: Synthetic peptide
QQQQHHH

SEQ ID NO: 2182 - protein, 7 aa, Artificial Sequence
  Description of Artificial Sequence: Synthetic peptide
HHHQQQQ

SEQ ID NO: 2183 - protein, 7 aa, Artificial Sequence
  Description of Artificial Sequence: Synthetic peptide
HQHHQQQ

SEQ ID NO: 2184 - protein, 7 aa, Artificial Sequence
  Description of Artificial Sequence: Synthetic peptide
HQHQHQQ

SEQ ID NO: 2185 - protein, 7 aa, Artificial Sequence
  Description of Artificial Sequence: Synthetic peptide
HQHQQHQ

SEQ ID NO: 2186 - protein, 7 aa, Artificial Sequence
  Description of Artificial Sequence: Synthetic peptide
HQHQQQH

SEQ ID NO: 2187 - protein, 7 aa, Artificial Sequence
  Description of Artificial Sequence: Synthetic peptide
HQQHHQQ

SEQ ID NO: 2188 - protein, 7 aa, Artificial Sequence
  Description of Artificial Sequence: Synthetic peptide
HQQHQHQ

SEQ ID NO: 2189 - protein, 7 aa, Artificial Sequence
  Description of Artificial Sequence: Synthetic peptide
HQQHQQH

SEQ ID NO: 2190 - protein, 7 aa, Artificial Sequence
  Description of Artificial Sequence: Synthetic peptide
HQQQHQH

SEQ ID NO: 2191 - protein, 7 aa, Artificial Sequence
  Description of Artificial Sequence: Synthetic peptide
HQQQHHQ

SEQ ID NO: 2192 - protein, 7 aa, Artificial Sequence
  Description of Artificial Sequence: Synthetic peptide
HQQQQHH

SEQ ID NO: 2193 - protein, 7 aa, Artificial Sequence
  Description of Artificial Sequence: Synthetic peptide
HHQHQQQ

SEQ ID NO: 2194 - protein, 7 aa, Artificial Sequence
  Description of Artificial Sequence: Synthetic peptide
HHQQHQQ

SEQ ID NO: 2195 - protein, 7 aa, Artificial Sequence
  Description of Artificial Sequence: Synthetic peptide
HHQQQHQ

SEQ ID NO: 2196 - protein, 7 aa, Artificial Sequence
  Description of Artificial Sequence: Synthetic peptide
HHQQQQH

SEQ ID NO: 2197 - protein, 7 aa, Artificial Sequence
  Description of Artificial Sequence: Synthetic peptide
QHHHQQQ

SEQ ID NO: 2198 - protein, 7 aa, Artificial Sequence
  Description of Artificial Sequence: Synthetic peptide
QHHQHQQ

SEQ ID NO: 2199 - protein, 7 aa, Artificial Sequence
  Description of Artificial Sequence: Synthetic peptide
QHHQQHQ

SEQ ID NO: 2200 - protein, 7 aa, Artificial Sequence
  Description of Artificial Sequence: Synthetic peptide
QHHQQQH

SEQ ID NO: 2201 - protein, 7 aa, Artificial Sequence
  Description of Artificial Sequence: Synthetic peptide
QHQHHQQ

SEQ ID NO: 2202 - protein, 7 aa, Artificial Sequence
  Description of Artificial Sequence: Synthetic peptide
QHQQHHQ

SEQ ID NO: 2203 - protein, 7 aa, Artificial Sequence
  Description of Artificial Sequence: Synthetic peptide
QHQQQHH

SEQ ID NO: 2204 - protein, 7 aa, Artificial Sequence
  Description of Artificial Sequence: Synthetic peptide
QHQHQHQ

SEQ ID NO: 2205 - protein, 7 aa, Artificial Sequence
  Description of Artificial Sequence: Synthetic peptide
QHQHQQH

SEQ ID NO: 2206 - protein, 7 aa, Artificial Sequence
  Description of Artificial Sequence: Synthetic peptide
QHQQHQH

SEQ ID NO: 2207 - protein, 7 aa, Artificial Sequence
  Description of Artificial Sequence: Synthetic peptide
QQHHHQQ

SEQ ID NO: 2208 - protein, 7 aa, Artificial Sequence
  Description of Artificial Sequence: Synthetic peptide
QQHHQHQ

SEQ ID NO: 2209 - protein, 7 aa, Artificial Sequence
  Description of Artificial Sequence: Synthetic peptide
QQHHQQH

SEQ ID NO: 2210 - protein, 7 aa, Artificial Sequence
  Description of Artificial Sequence: Synthetic peptide
QQHQHHQ

SEQ ID NO: 2211 - protein, 7 aa, Artificial Sequence
  Description of Artificial Sequence: Synthetic peptide
QQHQHQH

SEQ ID NO: 2212 - protein, 7 aa, Artificial Sequence
  Description of Artificial Sequence: Synthetic peptide
QQHQQHH

SEQ ID NO: 2213 - protein, 7 aa, Artificial Sequence
  Description of Artificial Sequence: Synthetic peptide
QQQHHHQ

SEQ ID NO: 2214 - protein, 7 aa, Artificial Sequence
  Description of Artificial Sequence: Synthetic peptide
QQQHHQH

SEQ ID NO: 2215 - protein, 7 aa, Artificial Sequence
  Description of Artificial Sequence: Synthetic peptide
QQQHQHH

SEQ ID NO: 2216 - protein, 7 aa, Artificial Sequence
  Description of Artificial Sequence: Synthetic peptide
QQQQQHH

SEQ ID NO: 2217 - protein, 7 aa, Artificial Sequence
  Description of Artificial Sequence: Synthetic peptide
HHQQQQQ

SEQ ID NO: 2218 - protein, 7 aa, Artificial Sequence
  Description of Artificial Sequence: Synthetic peptide
HQHQQQQ

SEQ ID NO: 2219 - protein, 7 aa, Artificial Sequence
  Description of Artificial Sequence: Synthetic peptide
HQQHQQQ

SEQ ID NO: 2220 - protein, 7 aa, Artificial Sequence
  Description of Artificial Sequence: Synthetic peptide
HQQQHQQ

SEQ ID NO: 2221 - protein, 7 aa, Artificial Sequence
  Description of Artificial Sequence: Synthetic peptide
HQQQQHQ

SEQ ID NO: 2222 - protein, 7 aa, Artificial Sequence
  Description of Artificial Sequence: Synthetic peptide
HQQQQQH

SEQ ID NO: 2223 - protein, 7 aa, Artificial Sequence
  Description of Artificial Sequence: Synthetic peptide
QHHQQQQ

SEQ ID NO: 2224 - protein, 7 aa, Artificial Sequence
  Description of Artificial Sequence: Synthetic peptide
QHQHQQQ

SEQ ID NO: 2225 - protein, 7 aa, Artificial Sequence
  Description of Artificial Sequence: Synthetic peptide
QHQQHQQ

SEQ ID NO: 2226 - protein, 7 aa, Artificial Sequence
  Description of Artificial Sequence: Synthetic peptide
QHQQQHQ

SEQ ID NO: 2227 - protein, 7 aa, Artificial Sequence
  Description of Artificial Sequence: Synthetic peptide
QHQQQQH

SEQ ID NO: 2228 - protein, 7 aa, Artificial Sequence
  Description of Artificial Sequence: Synthetic peptide
QQHHQQQ

SEQ ID NO: 2229 - protein, 7 aa, Artificial Sequence
  Description of Artificial Sequence: Synthetic peptide
QQHQHQQ

SEQ ID NO: 2230 - protein, 7 aa, Artificial Sequence
  Description of Artificial Sequence: Synthetic peptide
QQHQQHQ

SEQ ID NO: 2231 - protein, 7 aa, Artificial Sequence
  Description of Artificial Sequence: Synthetic peptide
QQHQQQH

SEQ ID NO: 2232 - protein, 7 aa, Artificial Sequence
  Description of Artificial Sequence: Synthetic peptide
QQQHHQQ

SEQ ID NO: 2233 - protein, 7 aa, Artificial Sequence
  Description of Artificial Sequence: Synthetic peptide
QQQHQHQ

SEQ ID NO: 2234 - protein, 7 aa, Artificial Sequence
  Description of Artificial Sequence: Synthetic peptide
QQQHQQH

SEQ ID NO: 2235 - protein, 7 aa, Artificial Sequence
  Description of Artificial Sequence: Synthetic peptide
QQQQHHQ

SEQ ID NO: 2236 - protein, 7 aa, Artificial Sequence
  Description of Artificial Sequence: Synthetic peptide
QQQQHQH

SEQ ID NO: 2237 - protein, 7 aa, Artificial Sequence
  Description of Artificial Sequence: Synthetic peptide
QQQQQQH

SEQ ID NO: 2238 - protein, 7 aa, Artificial Sequence
  Description of Artificial Sequence: Synthetic peptide
HQQQQQQ

SEQ ID NO: 2239 - protein, 7 aa, Artificial Sequence
  Description of Artificial Sequence: Synthetic peptide
QHQQQQQ

SEQ ID NO: 2240 - protein, 7 aa, Artificial Sequence
  Description of Artificial Sequence: Synthetic peptide
QQHQQQQ

SEQ ID NO: 2241 - protein, 7 aa, Artificial Sequence
  Description of Artificial Sequence: Synthetic peptide
QQQHQQQ

SEQ ID NO: 2242 - protein, 7 aa, Artificial Sequence
  Description of Artificial Sequence: Synthetic peptide
QQQQHQQ

SEQ ID NO: 2243 - protein, 7 aa, Artificial Sequence
  Description of Artificial Sequence: Synthetic peptide
QQQQQHQ

SEQ ID NO: 2244 - protein, 4 aa, Artificial Sequence
  Description of Artificial Sequence: Synthetic peptide
QQQN

SEQ ID NO: 2245 - protein, 4 aa, Artificial Sequence
  Description of Artificial Sequence: Synthetic peptide
NQQQ

SEQ ID NO: 2246 - protein, 4 aa, Artificial Sequence
  Description of Artificial Sequence: Synthetic peptide
QNQQ

SEQ ID NO: 2247 - protein, 4 aa, Artificial Sequence
  Description of Artificial Sequence: Synthetic peptide
QQNQ

SEQ ID NO: 2248 - protein, 5 aa, Artificial Sequence
  Description of Artificial Sequence: Synthetic peptide
QQQQN

SEQ ID NO: 2249 - protein, 5 aa, Artificial Sequence
  Description of Artificial Sequence: Synthetic peptide
NQQQQ

SEQ ID NO: 2250 - protein, 5 aa, Artificial Sequence
  Description of Artificial Sequence: Synthetic peptide
QNQQQ

SEQ ID NO: 2251 - protein, 5 aa, Artificial Sequence
  Description of Artificial Sequence: Synthetic peptide
QQNQQ

SEQ ID NO: 2252 - protein, 5 aa, Artificial Sequence
  Description of Artificial Sequence: Synthetic peptide
QQQNQ

SEQ ID NO: 2253 - protein, 5 aa, Artificial Sequence
  Description of Artificial Sequence: Synthetic peptide
QQQNN

SEQ ID NO: 2254 - protein, 5 aa, Artificial Sequence
  Description of Artificial Sequence: Synthetic peptide
NNQQQ

SEQ ID NO: 2255 - protein, 5 aa, Artificial Sequence
  Description of Artificial Sequence: Synthetic peptide
NQNQQ

SEQ ID NO: 2256 - protein, 5 aa, Artificial Sequence
  Description of Artificial Sequence: Synthetic peptide
NQQNQ

SEQ ID NO: 2257 - protein, 5 aa, Artificial Sequence
  Description of Artificial Sequence: Synthetic peptide
NQQQN

SEQ ID NO: 2258 - protein, 5 aa, Artificial Sequence
  Description of Artificial Sequence: Synthetic peptide
QNNQQ

SEQ ID NO: 2259 - protein, 5 aa, Artificial Sequence
  Description of Artificial Sequence: Synthetic peptide
QNQNQ

SEQ ID NO: 2260 - protein, 5 aa, Artificial Sequence
  Description of Artificial Sequence: Synthetic peptide
QNQQN

SEQ ID NO: 2261 - protein, 5 aa, Artificial Sequence
  Description of Artificial Sequence: Synthetic peptide
QQNNQ

SEQ ID NO: 2262 - protein, 5 aa, Artificial Sequence
  Description of Artificial Sequence: Synthetic peptide
QQNQN

SEQ ID NO: 2263 - protein, 6 aa, Artificial Sequence
  Description of Artificial Sequence: Synthetic peptide
QQQQQN

SEQ ID NO: 2264 - protein, 6 aa, Artificial Sequence
  Description of Artificial Sequence: Synthetic peptide
NQQQQQ

SEQ ID NO: 2265 - protein, 6 aa, Artificial Sequence
  Description of Artificial Sequence: Synthetic peptide
QNQQQQ

SEQ ID NO: 2266 - protein, 6 aa, Artificial Sequence
  Description of Artificial Sequence: Synthetic peptide
QQNQQQ

SEQ ID NO: 2267 - protein, 6 aa, Artificial Sequence
  Description of Artificial Sequence: Synthetic peptide
QQQNQQ

SEQ ID NO: 2268 - protein, 6 aa, Artificial Sequence
  Description of Artificial Sequence: Synthetic peptide
QQQQNQ

SEQ ID NO: 2269 - protein, 6 aa, Artificial Sequence
  Description of Artificial Sequence: Synthetic peptide
QQQQNN

SEQ ID NO: 2270 - protein, 6 aa, Artificial Sequence
  Description of Artificial Sequence: Synthetic peptide
NNQQQQ

SEQ ID NO: 2271 - protein, 6 aa, Artificial Sequence
  Description of Artificial Sequence: Synthetic peptide
NQNQQQ

SEQ ID NO: 2272 - protein, 6 aa, Artificial Sequence
  Description of Artificial Sequence: Synthetic peptide
NQQNQQ

SEQ ID NO: 2273 - protein, 6 aa, Artificial Sequence
  Description of Artificial Sequence: Synthetic peptide
NQQQNQ

SEQ ID NO: 2274 - protein, 6 aa, Artificial Sequence
  Description of Artificial Sequence: Synthetic peptide
NQQQQN

SEQ ID NO: 2275 - protein, 6 aa, Artificial Sequence
  Description of Artificial Sequence: Synthetic peptide
QNNQQQ

SEQ ID NO: 2276 - protein, 6 aa, Artificial Sequence
  Description of Artificial Sequence: Synthetic peptide
QNQNQQ

SEQ ID NO: 2277 - protein, 6 aa, Artificial Sequence
  Description of Artificial Sequence: Synthetic peptide
QNQQNQ

SEQ ID NO: 2278 - protein, 6 aa, Artificial Sequence
  Description of Artificial Sequence: Synthetic peptide
QNQQQN

SEQ ID NO: 2279 - protein, 6 aa, Artificial Sequence
  Description of Artificial Sequence: Synthetic peptide
QQNNQQ

SEQ ID NO: 2280 - protein, 6 aa, Artificial Sequence
  Description of Artificial Sequence: Synthetic peptide
QQNQNQ

SEQ ID NO: 2281 - protein, 6 aa, Artificial Sequence
  Description of Artificial Sequence: Synthetic peptide
QQNQQN

SEQ ID NO: 2282 - protein, 6 aa, Artificial Sequence
  Description of Artificial Sequence: Synthetic peptide
QQQNNQ

SEQ ID NO: 2283 - protein, 6 aa, Artificial Sequence
  Description of Artificial Sequence: Synthetic peptide
QQQNQN

SEQ ID NO: 2284 - protein, 7 aa, Artificial Sequence
  Description of Artificial Sequence: Synthetic peptide
QQQQNNN

SEQ ID NO: 2285 - protein, 7 aa, Artificial Sequence
  Description of Artificial Sequence: Synthetic peptide
NNNQQQQ

SEQ ID NO: 2286 - protein, 7 aa, Artificial Sequence
  Description of Artificial Sequence: Synthetic peptide
NQNNQQQ

SEQ ID NO: 2287 - protein, 7 aa, Artificial Sequence
  Description of Artificial Sequence: Synthetic peptide
NQNQNQQ

SEQ ID NO: 2288 - protein, 7 aa, Artificial Sequence
  Description of Artificial Sequence: Synthetic peptide
NQNQQNQ

SEQ ID NO: 2289 - protein, 7 aa, Artificial Sequence
  Description of Artificial Sequence: Synthetic peptide
NQNQQQN

SEQ ID NO: 2290 - protein, 7 aa, Artificial Sequence
  Description of Artificial Sequence: Synthetic peptide
NQQNNQQ

SEQ ID NO: 2291 - protein, 7 aa, Artificial Sequence
  Description of Artificial Sequence: Synthetic peptide
NQQNQNQ

SEQ ID NO: 2292 - protein, 7 aa, Artificial Sequence
  Description of Artificial Sequence: Synthetic peptide
NQQNQQN

SEQ ID NO: 2293 - protein, 7 aa, Artificial Sequence
  Description of Artificial Sequence: Synthetic peptide
NQQQNQN

SEQ ID NO: 2294 - protein, 7 aa, Artificial Sequence
  Description of Artificial Sequence: Synthetic peptide
NQQQNNQ

SEQ ID NO: 2295 - protein, 7 aa, Artificial Sequence
  Description of Artificial Sequence: Synthetic peptide
NQQQQNN

SEQ ID NO: 2296 - protein, 7 aa, Artificial Sequence
  Description of Artificial Sequence: Synthetic peptide
NNQNQQQ

SEQ ID NO: 2297 - protein, 7 aa, Artificial Sequence
  Description of Artificial Sequence: Synthetic peptide
NNQQNQQ

SEQ ID NO: 2298 - protein, 7 aa, Artificial Sequence
  Description of Artificial Sequence: Synthetic peptide
NNQQQNQ

SEQ ID NO: 2299 - protein, 7 aa, Artificial Sequence
  Description of Artificial Sequence: Synthetic peptide
NNQQQQN

SEQ ID NO: 2300 - protein, 7 aa, Artificial Sequence
  Description of Artificial Sequence: Synthetic peptide
QNNNQQQ

SEQ ID NO: 2301 - protein, 7 aa, Artificial Sequence
  Description of Artificial Sequence: Synthetic peptide
QNNQNQQ

SEQ ID NO: 2302 - protein, 7 aa, Artificial Sequence
  Description of Artificial Sequence: Synthetic peptide
QNNQQNQ

SEQ ID NO: 2303 - protein, 7 aa, Artificial Sequence
  Description of Artificial Sequence: Synthetic peptide
QNNQQQN

SEQ ID NO: 2304 - protein, 7 aa, Artificial Sequence
  Description of Artificial Sequence: Synthetic peptide
QNQNNQQ

SEQ ID NO: 2305 - protein, 7 aa, Artificial Sequence
  Description of Artificial Sequence: Synthetic peptide
QNQQNNQ

SEQ ID NO: 2306 - protein, 7 aa, Artificial Sequence
  Description of Artificial Sequence: Synthetic peptide
QNQQQNN

SEQ ID NO: 2307 - protein, 7 aa, Artificial Sequence
  Description of Artificial Sequence: Synthetic peptide
QNQNQNQ

SEQ ID NO: 2308 - protein, 7 aa, Artificial Sequence
  Description of Artificial Sequence: Synthetic peptide
QNQNQQN

SEQ ID NO: 2309 - protein, 7 aa, Artificial Sequence
  Description of Artificial Sequence: Synthetic peptide
QNQQNQN

SEQ ID NO: 2310 - protein, 7 aa, Artificial Sequence
  Description of Artificial Sequence: Synthetic peptide
QQNNNQQ

SEQ ID NO: 2311 - protein, 7 aa, Artificial Sequence
  Description of Artificial Sequence: Synthetic peptide
QQNNQNQ

SEQ ID NO: 2312 - protein, 7 aa, Artificial Sequence
  Description of Artificial Sequence: Synthetic peptide
QQNNQQN

SEQ ID NO: 2313 - protein, 7 aa, Artificial Sequence
  Description of Artificial Sequence: Synthetic peptide
QQNQNNQ

SEQ ID NO: 2314 - protein, 7 aa, Artificial Sequence
  Description of Artificial Sequence: Synthetic peptide
QQNQNQN

SEQ ID NO: 2315 - protein, 7 aa, Artificial Sequence
  Description of Artificial Sequence: Synthetic peptide
QQNQQNN

SEQ ID NO: 2316 - protein, 7 aa, Artificial Sequence
  Description of Artificial Sequence: Synthetic peptide
QQQNNNQ

SEQ ID NO: 2317 - protein, 7 aa, Artificial Sequence
  Description of Artificial Sequence: Synthetic peptide
QQQNNQN

SEQ ID NO: 2318 - protein, 7 aa, Artificial Sequence
  Description of Artificial Sequence: Synthetic peptide
QQQNQNN

SEQ ID NO: 2319 - protein, 7 aa, Artificial Sequence
  Description of Artificial Sequence: Synthetic peptide
QQQQQNN

SEQ ID NO: 2320 - protein, 7 aa, Artificial Sequence
  Description of Artificial Sequence: Synthetic peptide
NNQQQQQ

SEQ ID NO: 2321 - protein, 7 aa, Artificial Sequence
  Description of Artificial Sequence: Synthetic peptide
NQNQQQQ

SEQ ID NO: 2322 - protein, 7 aa, Artificial Sequence
  Description of Artificial Sequence: Synthetic peptide
NQQNQQQ

SEQ ID NO: 2323 - protein, 7 aa, Artificial Sequence
  Description of Artificial Sequence: Synthetic peptide
NQQQNQQ

SEQ ID NO: 2324 - protein, 7 aa, Artificial Sequence
  Description of Artificial Sequence: Synthetic peptide
NQQQQNQ

SEQ ID NO: 2325 - protein, 7 aa, Artificial Sequence
  Description of Artificial Sequence: Synthetic peptide
NQQQQQN

SEQ ID NO: 2326 - protein, 7 aa, Artificial Sequence
  Description of Artificial Sequence: Synthetic peptide
QNNQQQQ

SEQ ID NO: 2327 - protein, 7 aa, Artificial Sequence
  Description of Artificial Sequence: Synthetic peptide
QNQNQQQ

SEQ ID NO: 2328 - protein, 7 aa, Artificial Sequence
  Description of Artificial Sequence: Synthetic peptide
QNQQNQQ

SEQ ID NO: 2329 - protein, 7 aa, Artificial Sequence
  Description of Artificial Sequence: Synthetic peptide
QNQQQNQ

SEQ ID NO: 2330 - protein, 7 aa, Artificial Sequence
  Description of Artificial Sequence: Synthetic peptide
QNQQQQN

SEQ ID NO: 2331 - protein, 7 aa, Artificial Sequence
  Description of Artificial Sequence: Synthetic peptide
QQNNQQQ

SEQ ID NO: 2332 - protein, 7 aa, Artificial Sequence
  Description of Artificial Sequence: Synthetic peptide
QQNQNQQ

SEQ ID NO: 2333 - protein, 7 aa, Artificial Sequence
  Description of Artificial Sequence: Synthetic peptide
QQNQQNQ

SEQ ID NO: 2334 - protein, 7 aa, Artificial Sequence
  Description of Artificial Sequence: Synthetic peptide
QQNQQQN

SEQ ID NO: 2335 - protein, 7 aa, Artificial Sequence
  Description of Artificial Sequence: Synthetic peptide
QQQNNQQ

SEQ ID NO: 2336 - protein, 7 aa, Artificial Sequence
  Description of Artificial Sequence: Synthetic peptide
QQQNQNQ

SEQ ID NO: 2337 - protein, 7 aa, Artificial Sequence
  Description of Artificial Sequence: Synthetic peptide
QQQNQQN

SEQ ID NO: 2338 - protein, 7 aa, Artificial Sequence
  Description of Artificial Sequence: Synthetic peptide
QQQQNNQ

SEQ ID NO: 2339 - protein, 7 aa, Artificial Sequence
  Description of Artificial Sequence: Synthetic peptide
QQQQNQN

SEQ ID NO: 2340 - protein, 7 aa, Artificial Sequence
  Description of Artificial Sequence: Synthetic peptide
QQQQQQN

SEQ ID NO: 2341 - protein, 7 aa, Artificial Sequence
  Description of Artificial Sequence: Synthetic peptide
NQQQQQQ

SEQ ID NO: 2342 - protein, 7 aa, Artificial Sequence
  Description of Artificial Sequence: Synthetic peptide
QNQQQQQ

SEQ ID NO: 2343 - protein, 7 aa, Artificial Sequence
  Description of Artificial Sequence: Synthetic peptide
QQNQQQQ

SEQ ID NO: 2344 - protein, 7 aa, Artificial Sequence
  Description of Artificial Sequence: Synthetic peptide
QQQNQQQ

SEQ ID NO: 2345 - protein, 7 aa, Artificial Sequence
  Description of Artificial Sequence: Synthetic peptide
QQQQNQQ

SEQ ID NO: 2346 - protein, 7 aa, Artificial Sequence
  Description of Artificial Sequence: Synthetic peptide
QQQQQNQ

SEQ ID NO: 2347 - protein, 4 aa, Artificial Sequence
  Description of Artificial Sequence: Synthetic peptide
QQQD

SEQ ID NO: 2348 - protein, 4 aa, Artificial Sequence
  Description of Artificial Sequence: Synthetic peptide
DQQQ

SEQ ID NO: 2349 - protein, 4 aa, Artificial Sequence
  Description of Artificial Sequence: Synthetic peptide
QDQQ

SEQ ID NO: 2350 - protein, 4 aa, Artificial Sequence
  Description of Artificial Sequence: Synthetic peptide
QQDQ

SEQ ID NO: 2351 - protein, 5 aa, Artificial Sequence
  Description of Artificial Sequence: Synthetic peptide
QQQQD

SEQ ID NO: 2352 - protein, 5 aa, Artificial Sequence
  Description of Artificial Sequence: Synthetic peptide
DQQQQ

SEQ ID NO: 2353 - protein, 5 aa, Artificial Sequence
  Description of Artificial Sequence: Synthetic peptide
QDQQQ

SEQ ID NO: 2354 - protein, 5 aa, Artificial Sequence
  Description of Artificial Sequence: Synthetic peptide
QQDQQ

SEQ ID NO: 2355 - protein, 5 aa, Artificial Sequence
  Description of Artificial Sequence: Synthetic peptide
QQQDQ

SEQ ID NO: 2356 - protein, 5 aa, Artificial Sequence
  Description of Artificial Sequence: Synthetic peptide
QQQDD

SEQ ID NO: 2357 - protein, 5 aa, Artificial Sequence
  Description of Artificial Sequence: Synthetic peptide
DDQQQ

SEQ ID NO: 2358 - protein, 5 aa, Artificial Sequence
  Description of Artificial Sequence: Synthetic peptide
DQDQQ

SEQ ID NO: 2359 - protein, 5 aa, Artificial Sequence
  Description of Artificial Sequence: Synthetic peptide
DQQDQ

SEQ ID NO: 2360 - protein, 5 aa, Artificial Sequence
  Description of Artificial Sequence: Synthetic peptide
DQQQD

SEQ ID NO: 2361 - protein, 5 aa, Artificial Sequence
  Description of Artificial Sequence: Synthetic peptide
QDDQQ

SEQ ID NO: 2362 - protein, 5 aa, Artificial Sequence
  Description of Artificial Sequence: Synthetic peptide
QDQDQ

SEQ ID NO: 2363 - protein, 5 aa, Artificial Sequence
  Description of Artificial Sequence: Synthetic peptide
QDQQD

SEQ ID NO: 2364 - protein, 5 aa, Artificial Sequence
  Description of Artificial Sequence: Synthetic peptide
QQDDQ

SEQ ID NO: 2365 - protein, 5 aa, Artificial Sequence
  Description of Artificial Sequence: Synthetic peptide
QQDQD

SEQ ID NO: 2366 - protein, 6 aa, Artificial Sequence
  Description of Artificial Sequence: Synthetic peptide
QQQQQD

SEQ ID NO: 2367 - protein, 6 aa, Artificial Sequence
  Description of Artificial Sequence: Synthetic peptide
DQQQQQ

SEQ ID NO: 2368 - protein, 6 aa, Artificial Sequence
  Description of Artificial Sequence: Synthetic peptide
QDQQQQ

SEQ ID NO: 2369 - protein, 6 aa, Artificial Sequence
  Description of Artificial Sequence: Synthetic peptide
QQDQQQ

SEQ ID NO: 2370 - protein, 6 aa, Artificial Sequence
  Description of Artificial Sequence: Synthetic peptide
QQQDQQ

SEQ ID NO: 2371 - protein, 6 aa, Artificial Sequence
  Description of Artificial Sequence: Synthetic peptide
QQQQDQ

SEQ ID NO: 2372 - protein, 6 aa, Artificial Sequence
  Description of Artificial Sequence: Synthetic peptide
QQQQDD

SEQ ID NO: 2373 - protein, 6 aa, Artificial Sequence
  Description of Artificial Sequence: Synthetic peptide
DDQQQQ

SEQ ID NO: 2374 - protein, 6 aa, Artificial Sequence
  Description of Artificial Sequence: Synthetic peptide
DQDQQQ

SEQ ID NO: 2375 - protein, 6 aa, Artificial Sequence
  Description of Artificial Sequence: Synthetic peptide
DQQDQQ

SEQ ID NO: 2376 - protein, 6 aa, Artificial Sequence
  Description of Artificial Sequence: Synthetic peptide
DQQQDQ

SEQ ID NO: 2377 - protein, 6 aa, Artificial Sequence
  Description of Artificial Sequence: Synthetic peptide
DQQQQD

SEQ ID NO: 2378 - protein, 6 aa, Artificial Sequence
  Description of Artificial Sequence: Synthetic peptide
QDDQQQ

SEQ ID NO: 2379 - protein, 6 aa, Artificial Sequence
  Description of Artificial Sequence: Synthetic peptide
QDQDQQ

SEQ ID NO: 2380 - protein, 6 aa, Artificial Sequence
  Description of Artificial Sequence: Synthetic peptide
QDQQDQ

SEQ ID NO: 2381 - protein, 6 aa, Artificial Sequence
  Description of Artificial Sequence: Synthetic peptide
QDQQQD

SEQ ID NO: 2382 - protein, 6 aa, Artificial Sequence
  Description of Artificial Sequence: Synthetic peptide
QQDDQQ

SEQ ID NO: 2383 - protein, 6 aa, Artificial Sequence
  Description of Artificial Sequence: Synthetic peptide
QQDQDQ

SEQ ID NO: 2384 - protein, 6 aa, Artificial Sequence
  Description of Artificial Sequence: Synthetic peptide
QQDQQD

SEQ ID NO: 2385 - protein, 6 aa, Artificial Sequence
  Description of Artificial Sequence: Synthetic peptide
QQQDDQ

SEQ ID NO: 2386 - protein, 6 aa, Artificial Sequence
  Description of Artificial Sequence: Synthetic peptide
QQQDQD

SEQ ID NO: 2387 - protein, 7 aa, Artificial Sequence
  Description of Artificial Sequence: Synthetic peptide
QQQQDDD

SEQ ID NO: 2388 - protein, 7 aa, Artificial Sequence
  Description of Artificial Sequence: Synthetic peptide
DDDQQQQ

SEQ ID NO: 2389 - protein, 7 aa, Artificial Sequence
  Description of Artificial Sequence: Synthetic peptide
DQDDQQQ

SEQ ID NO: 2390 - protein, 7 aa, Artificial Sequence
  Description of Artificial Sequence: Synthetic peptide
DQDQDQQ

SEQ ID NO: 2391 - protein, 7 aa, Artificial Sequence
  Description of Artificial Sequence: Synthetic peptide
DQDQQDQ

SEQ ID NO: 2392 - protein, 7 aa, Artificial Sequence
  Description of Artificial Sequence: Synthetic peptide
DQDQQQD

SEQ ID NO: 2393 - protein, 7 aa, Artificial Sequence
  Description of Artificial Sequence: Synthetic peptide
DQQDDQQ

SEQ ID NO: 2394 - protein, 7 aa, Artificial Sequence
  Description of Artificial Sequence: Synthetic peptide
DQQDQDQ

SEQ ID NO: 2395 - protein, 7 aa, Artificial Sequence
  Description of Artificial Sequence: Synthetic peptide
DQQDQQD

SEQ ID NO: 2396 - protein, 7 aa, Artificial Sequence
  Description of Artificial Sequence: Synthetic peptide
DQQQDQD

SEQ ID NO: 2397 - protein, 7 aa, Artificial Sequence
  Description of Artificial Sequence: Synthetic peptide
DQQQDDQ

SEQ ID NO: 2398 - protein, 7 aa, Artificial Sequence
  Description of Artificial Sequence: Synthetic peptide
DQQQQDD

SEQ ID NO: 2399 - protein, 7 aa, Artificial Sequence
  Description of Artificial Sequence: Synthetic peptide
DDQDQQQ

SEQ ID NO: 2400 - protein, 7 aa, Artificial Sequence
  Description of Artificial Sequence: Synthetic peptide
DDQQDQQ

SEQ ID NO: 2401 - protein, 7 aa, Artificial Sequence
  Description of Artificial Sequence: Synthetic peptide
DDQQQDQ

SEQ ID NO: 2402 - protein, 7 aa, Artificial Sequence
  Description of Artificial Sequence: Synthetic peptide
DDQQQQD

SEQ ID NO: 2403 - protein, 7 aa, Artificial Sequence
  Description of Artificial Sequence: Synthetic peptide
QDDDQQQ

SEQ ID NO: 2404 - protein, 7 aa, Artificial Sequence
  Description of Artificial Sequence: Synthetic peptide
QDDQDQQ

SEQ ID NO: 2405 - protein, 7 aa, Artificial Sequence
  Description of Artificial Sequence: Synthetic peptide
QDDQQDQ

SEQ ID NO: 2406 - protein, 7 aa, Artificial Sequence
  Description of Artificial Sequence: Synthetic peptide
QDDQQQD

SEQ ID NO: 2407 - protein, 7 aa, Artificial Sequence
  Description of Artificial Sequence: Synthetic peptide
QDQDDQQ

SEQ ID NO: 2408 - protein, 7 aa, Artificial Sequence
  Description of Artificial Sequence: Synthetic peptide
QDQQDDQ

SEQ ID NO: 2409 - protein, 7 aa, Artificial Sequence
  Description of Artificial Sequence: Synthetic peptide
QDQQQDD

SEQ ID NO: 2410 - protein, 7 aa, Artificial Sequence
  Description of Artificial Sequence: Synthetic peptide
QDQDQDQ

SEQ ID NO: 2411 - protein, 7 aa, Artificial Sequence
  Description of Artificial Sequence: Synthetic peptide
QDQDQQD

SEQ ID NO: 2412 - protein, 7 aa, Artificial Sequence
  Description of Artificial Sequence: Synthetic peptide
QDQQDQD

SEQ ID NO: 2413 - protein, 7 aa, Artificial Sequence
  Description of Artificial Sequence: Synthetic peptide
QQDDDQQ

SEQ ID NO: 2414 - protein, 7 aa, Artificial Sequence
  Description of Artificial Sequence: Synthetic peptide
QQDDQDQ

SEQ ID NO: 2415 - protein, 7 aa, Artificial Sequence
  Description of Artificial Sequence: Synthetic peptide
QQDDQQD

SEQ ID NO: 2416 - protein, 7 aa, Artificial Sequence
  Description of Artificial Sequence: Synthetic peptide
QQDQDDQ

SEQ ID NO: 2417 - protein, 7 aa, Artificial Sequence
  Description of Artificial Sequence: Synthetic peptide
QQDQDQD

SEQ ID NO: 2418 - protein, 7 aa, Artificial Sequence
  Description of Artificial Sequence: Synthetic peptide
QQDQQDD

SEQ ID NO: 2419 - protein, 7 aa, Artificial Sequence
  Description of Artificial Sequence: Synthetic peptide
QQQDDDQ

SEQ ID NO: 2420 - protein, 7 aa, Artificial Sequence
  Description of Artificial Sequence: Synthetic peptide
QQQDDQD

SEQ ID NO: 2421 - protein, 7 aa, Artificial Sequence
  Description of Artificial Sequence: Synthetic peptide
QQQDQDD

SEQ ID NO: 2422 - protein, 7 aa, Artificial Sequence
  Description of Artificial Sequence: Synthetic peptide
QQQQQDD

SEQ ID NO: 2423 - protein, 7 aa, Artificial Sequence
  Description of Artificial Sequence: Synthetic peptide
DDQQQQQ

SEQ ID NO: 2424 - protein, 7 aa, Artificial Sequence
  Description of Artificial Sequence: Synthetic peptide
DQDQQQQ

SEQ ID NO: 2425 - protein, 7 aa, Artificial Sequence
  Description of Artificial Sequence: Synthetic peptide
DQQDQQQ

SEQ ID NO: 2426 - protein, 7 aa, Artificial Sequence
  Description of Artificial Sequence: Synthetic peptide
DQQQDQQ

SEQ ID NO: 2427 - protein, 7 aa, Artificial Sequence
  Description of Artificial Sequence: Synthetic peptide
DQQQQDQ

SEQ ID NO: 2428 - protein, 7 aa, Artificial Sequence
  Description of Artificial Sequence: Synthetic peptide
DQQQQQD

SEQ ID NO: 2429 - protein, 7 aa, Artificial Sequence
  Description of Artificial Sequence: Synthetic peptide
QDDQQQQ

SEQ ID NO: 2430 - protein, 7 aa, Artificial Sequence
  Description of Artificial Sequence: Synthetic peptide
QDQDQQQ

SEQ ID NO: 2431 - protein, 7 aa, Artificial Sequence
  Description of Artificial Sequence: Synthetic peptide
QDQQDQQ

SEQ ID NO: 2432 - protein, 7 aa, Artificial Sequence
  Description of Artificial Sequence: Synthetic peptide
QDQQQDQ

SEQ ID NO: 2433 - protein, 7 aa, Artificial Sequence
  Description of Artificial Sequence: Synthetic peptide
QDQQQQD

SEQ ID NO: 2434 - protein, 7 aa, Artificial Sequence
  Description of Artificial Sequence: Synthetic peptide
QQDDQQQ

SEQ ID NO: 2435 - protein, 7 aa, Artificial Sequence
  Description of Artificial Sequence: Synthetic peptide
QQDQDQQ

SEQ ID NO: 2436 - protein, 7 aa, Artificial Sequence
  Description of Artificial Sequence: Synthetic peptide
QQDQQDQ

SEQ ID NO: 2437 - protein, 7 aa, Artificial Sequence
  Description of Artificial Sequence: Synthetic peptide
QQDQQQD

SEQ ID NO: 2438 - protein, 7 aa, Artificial Sequence
  Description of Artificial Sequence: Synthetic peptide
QQQDDQQ

SEQ ID NO: 2439 - protein, 7 aa, Artificial Sequence
  Description of Artificial Sequence: Synthetic peptide
QQQDQDQ

SEQ ID NO: 2440 - protein, 7 aa, Artificial Sequence
  Description of Artificial Sequence: Synthetic peptide
QQQDQQD

SEQ ID NO: 2441 - protein, 7 aa, Artificial Sequence
  Description of Artificial Sequence: Synthetic peptide
QQQQDDQ

SEQ ID NO: 2442 - protein, 7 aa, Artificial Sequence
  Description of Artificial Sequence: Synthetic peptide
QQQQDQD

SEQ ID NO: 2443 - protein, 7 aa, Artificial Sequence
  Description of Artificial Sequence: Synthetic peptide
QQQQQQD

SEQ ID NO: 2444 - protein, 7 aa, Artificial Sequence
  Description of Artificial Sequence: Synthetic peptide
DQQQQQQ

SEQ ID NO: 2445 - protein, 7 aa, Artificial Sequence
  Description of Artificial Sequence: Synthetic peptide
QDQQQQQ

SEQ ID NO: 2446 - protein, 7 aa, Artificial Sequence
  Description of Artificial Sequence: Synthetic peptide
QQDQQQQ

SEQ ID NO: 2447 - protein, 7 aa, Artificial Sequence
  Description of Artificial Sequence: Synthetic peptide
QQQDQQQ

SEQ ID NO: 2448 - protein, 7 aa, Artificial Sequence
  Description of Artificial Sequence: Synthetic peptide
QQQQDQQ

SEQ ID NO: 2449 - protein, 7 aa, Artificial Sequence
  Description of Artificial Sequence: Synthetic peptide
QQQQQDQ

SEQ ID NO: 2450 - protein, 347 aa, Artificial Sequence
  Description of Artificial Sequence: Synthetic amino acid sequence
MFLQNLFLGFLAVVCANATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNN

SEQ ID NO: 2451 - DNA, 1044 bp, Artificial Sequence
  Description of Artificial Sequence: Synthetic nucleotide sequence
atgttcttgcaaaatttattccttggctttttggccgttgtttgcgcaaacgcgactccgctgggtccagctagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagccgacccagggtgccatgccggccttcgcctctgctttccagcgccgggcaggaggggtcctagttgcctcccatctgcagagcttcctggaggtgtcgtaccgcgttctacgccaccttgcccagcctaacaacaccaacaataccaacaatacaaacaacaccaacaataccaacaatacaaacaacaccaacaataccaacaatacaaacaacaccaacaataccaacaatacaaacaacaccaacaataccaacaatacaaacaacaccaacaataccaacaatacaaacaacaccaacaataccaacaatacaaacaacaccaataataccaacaatacaaacaacaccaataataccaacaatacaaacaacaccaataataccaacaatacaaacaacaccaataataccaacaatacaaacaacaccaataataccaacaatacaaacaacaccaataataccaacaatacaaacaacaccaataataccaacaatacaaacaacaccaataataccaacaatacaaacaacaccaataataccaacaatacaaacaacaccaataataccaacaatacaaacaactag

SEQ ID NO: 2452 - protein, 193 aa, Homo sapiens
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 2453 - DNA, 1340 bp, Homo sapiens
cccggagccggaccggggccaccgcgcccgctctgctccgacaccgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacgaatgtcctgcctggctgtggcttctcctgtccctgctgtcgctccctctgggcctcccagtcctgggcgccccaccacgcctcatctgtgacagccgagtcctggagaggtacctcttggaggccaaggaggccgagaatatcacgacgggctgtgctgaacactgcagcttgaatgagaatatcactgtcccagacaccaaagttaatttctatgcctggaagaggatggaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacagatgaccaggtgtgtccacctgggcatatccaccacctccctcaccaacattgcttgtgccacaccctcccccgccactcctgaaccccgtcgaggggctctcagctcagcgccagcctgtcccatggacactccagtgccagcaatgacatctcaggggccagaggaactgtccagagagcaactctgagatctaaggatgtcacagggccaacttgagggcccagagcaggaagcattcagagagcagctttaaactcagggacagagccatgctgggaagacgcctgagctcactcggcaccctgcaaaatttgatgccaggacacgctttggaggcgatttacctgttttcgcacctaccatcagggacaggatgacctggagaacttaggtggcaagctgtgacttctccaggtctcacgggcatgggcactcccttggtggcaagagcccccttgacaccggggtggtgggaaccatgaagacaggatgggggctggcctctggctctcatggggtccaagttttgtgtattcttcaacctcattgacaagaactgaaaccaccaaaaaaaaaaaa

SEQ ID NO: 2454 - protein, 554 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSSSPQLQESVFHLLVPSVILVLLAVGGLLFYRWRRRSHQEPQRADSPLEQPEGSPLTQDDRQVELPV

SEQ ID NO: 2455 - DNA, 2545 bp, Homo sapiens
gagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtacagccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagacccctcaccatcctggacacactcgtttgtcaatgtccctctgaaaatgtgacgcccagccccggacacagtactccagatgttgtctgaccagctcagagagagtacagtgggactgttaccttccttgatatggacagtattcttctatttgtgcagattaagattgcattagtttttttcttaacaactgcatcatactgttgtcatatgttgagcctgtggttctataaaacccctagttccatttcccataaacttctgtcaagccagaccatctctaccctgtacttggacaacttaacttttttaaccaaagtgcagtttatgttcacctttgttaaagccacctttgtggtttctgcccatcacctgaacctactgaagttgtgtgaaatcctaattctgtcatctccgtagccctcccagttgtgcctcctgcacattgatgagtgcctgctgttgtctttgcccatgttgttgatgtagctgtgaccctattgttcctcacccctgccccccgccaaccccagctggcccacctcttccccctcccacccaagcccacagccagcccatcaggaagccttcctggcttctccacaaccttctgactgtcttttcagtcatgccccctgctcttttgtatttggctaatagtatatcaatttgcactt

SEQ ID NO: 2456 - protein, 256 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQGHERQSEGSSSPQLQESVFHLLVPSVILVLLAVGGLLFYRWRRRSHQEPQRADSPLEQPEGSPLTQDDRQVELPV

SEQ ID NO: 2457 - DNA, 1855 bp, Homo sapiens
gagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaaggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctcccca

SEQ ID NO: 2458 - protein, 438 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGHERQSEGSSSPQLQESVFHLLVPSVILVLLAVGGLLFYRWRRRSHQEPQRADSPLEQPEGSPLTQDDRQVELPV

SEQ ID NO: 2459 - DNA, 1519 bp, Homo sapiens
gagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaag

SEQ ID NO: 2460 - protein, 554 aa, Homo sapiens; identical to SEQ ID NO: 2454

SEQ ID NO: 2461 - DNA, 2749 bp, Homo sapiens
gagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtacagccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctcccca

SEQ ID NO: 2462 - protein, 144 aa, Homo sapiens
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 2463 - DNA, 781 bp, Homo sapiens
acacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggccacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatatgcttcta

SEQ ID NO: 2464 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 2465 - DNA, 1669 bp, Homo sapiens
ctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaa

SEQ ID NO: 2466 - protein, 455 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 2467 - DNA, 2236 bp, Homo sapiens
gctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctctgctcttggaaaaaaaaaaaaaaaaaaaaaaaaaaaaaaaaa

SEQ ID NO: 2468 - protein, 187 aa, Homo sapiens
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 2469 - DNA, 840 bp, Homo sapiens
acattctaactgcaacctttcgaagcctttgctctggcacaacaggtagtaggcgacactgttcgtgttgtcaacatgaccaacaagtgtctcctccaaattgctctcctgttgtgcttctccactacagctctttccatgagctacaacttgcttggattcctacaaagaagcagcaattttcagtgtcagaagctcctgtggcaattgaatgggaggcttgaatactgcctcaaggacaggatgaactttgacatccctgaggagattaagcagctgcagcagttccagaaggaggacgccgcattgaccatctatgagatgctccagaacatctttgctattttcagacaagattcatctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctaaggaacttttacttcattaacagacttacaggttacctccgaaactgaagatctcctagcctgtgcctctgggactggacaattgcttcaagcattcttcaaccagcagatgctgtttaagtgactgatggctaatgtactgcatatgaaaggacactagaagattttgaaatttttattaaattatgagttatttttatttatttaaattttattttggaaaataaattatttttggtgcaaaagtca

SEQ ID NO: 2470 - protein, 166 aa, Homo sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 2471 - DNA, 1240 bp, Homo sapiens
cacattgttctgatcatctgaagatcagctattagaagagaaagatcagttaagtcctttggacctgatcagcttgatacaagaactactgatttcaacttctttggcttaattctctcggaaacgatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaatggttgtcctgcctgcaatatttgaattttaaatctaaatctatttattaatatttaacattatttatatggggaatatatttttagactcatcaatcaaataagtatttataatagcaacttttgtgtaatgaaaatgaatatctattaatatatgtattatttataattcctatatcctgtgactgtctcacttaatcctttgttttctgactaattaggcaaggctatgtgattacaaggctttatctcaggggccaactaggcagccaacctaagcaagatcccatgggttgtgtgtttatttcacttgatgatacaatgaacacttataagtgaagtgatactatccagttactgccggtttgaaaatatgcctgcaatctgagccagtgctttaatggcatgtcagacagaacttgaatgtgtcaggtgaccctgatgaaaacatagcatctcaggagatttcatgcctggtgcttccaaatattgttgacaactgtgactgtacccaaatggaaagtaactcatttgttaaaattatcaatatctaatatatatgaataaagtgtaagttcacaacaaaaaaaaaaaaaaaaaaaaaaaaaaaaaa

SEQ ID NO: 2472 - protein, 202 aa, Homo sapiens
MATGSRTSLLLAFGLLCLPWLQEGSAFPTIPLSRLFDNASLRAHRLHQLAFDTYQEFNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 2473 - DNA, 1964 bp, Homo sapiens
agggcacccacgtgacccttaaagagaggacaagttgggtggtattttctggctgacactctgtgcacaaccctcacaacactggttgacggtgggaagggaaagatgacaagccaggggcatgatcccagcatgtgtgggaggagcttctaaattatccattagcacaagcccgtcagtggccccatgcataaatgtacacagaaacaggtgggggcaacagtgggagagaaggggccagggtataaaaagggcccacaagagaccggctcaaggatcccaaggcccaactccccgaaccactcagggtcctgtggacgctcacctagctgcaatggctacaggtaagcgcccctaaaatccctttgggcacaatgtgtcctgaggggagaggcagcgacctgtagatgggacgggggcactaaccctcaggtttggggcttctgaatgagtatcgccatgtaagcccagtatggccaatctcagaaagctcctggtccctggagggatggagagagaaaaacaaacagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctagtctccgcgcccatcgtctgcaccagctggcctttgacacctaccaggagtttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccgtgagtggatgccttgaccccaggcggggatgggggagacctgtagtcagagcccccgggcagcacaggccaatgcccgtccttcccctgcagaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatgggggtgggggtggcgctaggggtccccaatcttggagccccactgactttgagagctgtgttagagaaacactgctgccctctttttagcagtccaggccctgacccaagagaactcaccttattcttcatttcccctcgtgaatcctctagcctttctctacaccctgaaggggagggaggaaaatgaatgaatgagaaagggagggagcagtacccaagcgcttggcctctccttctcttccttcactttgcagaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccttggaagttgccactccagtgcccaccagccttgtcctaataaaattaagttgcatcattttgtctgactaggtgtcctctataatattatggggtggaggggggtggtttggagca

SEQ ID NO: 2474 - protein, 444 aa, Homo sapiens
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 2475 - DNA, 2412 bp, Homo sapiens
agtcccatggggaatgtcaacaggcaggggcagcactgcagagatttcatcatggtctcccaggccctcaggctcctctgccttctgcttgggcttcagggctgcctggctgcagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccaccc

SEQ ID NO: 2476 - protein, 2224 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFRSQEHAKRKGPKVERDQAAKHRFSWMKLLAHKVGRHLSQDTGSPSGMRPWEDLPSQDTGSPSRMRPWEDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTISLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 2477 - DNA, 6914 bp, Homo sapiens
tcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcagagaagatggacgacgctgtggctccaggccgagaatacacctatgaatggagtatcagtgaggacagtggacccacccatgatgaccctccatgcctcacacacatctattactcccatgaaaatctgatcgaggatttcaactctgggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcagaagtcaagaacatgctaagcgtaagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctgggaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccatttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatac

SEQ ID NO: 2478 - protein, 622 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 2479 - DNA, 1997 bp, Homo sapiens
aattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctagagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcacaaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtaggggccactcatattctgggctcctggaaccaatcccgtgaaagaattatttttgtgtttctaaaactatggttcccaataaaagtgactctcagcgg

SEQ ID NO: 2480 - protein, 165 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGD

SEQ ID NO: 2481 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 2482 - DNA, 12 bp, Artificial Sequence
  Description of Artificial Sequence: Synthetic oligonucleotide
  modified_base (12)..(12): a, c, g, t, unknown or other
aayaayaayacn

SEQ ID NO: 2483 - DNA, 12 bp, Artificial Sequence
  Description of Artificial Sequence: Synthetic oligonucleotide
  modified_base (3)..(3): a, c, g, t, unknown or other
acnaayaayaay

SEQ ID NO: 2484 - DNA, 12 bp, Artificial Sequence
  Description of Artificial Sequence: Synthetic oligonucleotide
  modified_base (6)..(6): a, c, g, t, unknown or other
aayacnaayaay

SEQ ID NO: 2485 - DNA, 12 bp, Artificial Sequence
  Description of Artificial Sequence: Synthetic oligonucleotide
  modified_base (9)..(9): a, c, g, t, unknown or other
aayaayacnaay

SEQ ID NO: 2486 - DNA, 15 bp, Artificial Sequence
  Description of Artificial Sequence: Synthetic oligonucleotide
  modified_base (15)..(15): a, c, g, t, unknown or other
aayaayaayaayacn

SEQ ID NO: 2487 - DNA, 15 bp, Artificial Sequence
  Description of Artificial Sequence: Synthetic oligonucleotide
  modified_base (3)..(3): a, c, g, t, unknown or other
acnaayaayaayaay

SEQ ID NO: 2488 - DNA, 15 bp, Artificial Sequence
  Description of Artificial Sequence: Synthetic oligonucleotide
  modified_base (6)..(6): a, c, g, t, unknown or other
aayacnaayaayaay

SEQ ID NO: 2489 - DNA, 15 bp, Artificial Sequence
  Description of Artificial Sequence: Synthetic oligonucleotide
  modified_base (9)..(9): a, c, g, t, unknown or other
aayaayacnaayaay

SEQ ID NO: 2490 - DNA, 15 bp, Artificial Sequence
  Description of Artificial Sequence: Synthetic oligonucleotide
  modified_base (12)..(12): a, c, g, t, unknown or other
aayaayaayacnaay

SEQ ID NO: 2491 - DNA, 15 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
aayaayaayacnacn

SEQ ID NO: 2492 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
acnacnaayaayaay

SEQ ID NO: 2493 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
acnaayacnaayaay

SEQ ID NO: 2494 - DNA, 15 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
acnaayaayacnaay

SEQ ID NO: 2495 - DNA, 15 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
acnaayaayaayacn

SEQ ID NO: 2496 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
aayacnacnaayaay

SEQ ID NO: 2497 - DNA, 15 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
aayacnaayacnaay

SEQ ID NO: 2498 - DNA, 15 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
aayacnaayaayacn

SEQ ID NO: 2499 - DNA, 15 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
aayaayacnacnaay

SEQ ID NO: 2500 - DNA, 15 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
aayaayacnaayacn

SEQ ID NO: 2501 - DNA, 18 bp, Artificial Sequence
  Description of Artificial Sequence: Synthetic oligonucleotide
  modified_base (18)..(18): a, c, g, t, unknown or other
aayaayaayaayaayacn

SEQ ID NO: 2502 - DNA, 18 bp, Artificial Sequence
  Description of Artificial Sequence: Synthetic oligonucleotide
  modified_base (3)..(3): a, c, g, t, unknown or other
acnaayaayaayaayaay

SEQ ID NO: 2503 - DNA, 18 bp, Artificial Sequence
  Description of Artificial Sequence: Synthetic oligonucleotide
  modified_base (6)..(6): a, c, g, t, unknown or other
aayacnaayaayaayaay

SEQ ID NO: 2504 - DNA, 18 bp, Artificial Sequence
  Description of Artificial Sequence: Synthetic oligonucleotide
  modified_base (9)..(9): a, c, g, t, unknown or other
aayaayacnaayaayaay

SEQ ID NO: 2505 - DNA, 18 bp, Artificial Sequence
  Description of Artificial Sequence: Synthetic oligonucleotide
  modified_base (12)..(12): a, c, g, t, unknown or other
aayaayaayacnaayaay

SEQ ID NO: 2506 - DNA, 18 bp, Artificial Sequence
  Description of Artificial Sequence: Synthetic oligonucleotide
  modified_base (15)..(15): a, c, g, t, unknown or other
aayaayaayaayacnaay

SEQ ID NO: 2507 - DNA, 18 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
aayaayaayaayacnacn

SEQ ID NO: 2508 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
acnacnaayaayaayaay

SEQ ID NO: 2509 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
acnaayacnaayaayaay

SEQ ID NO: 2510 - DNA, 18 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
acnaayaayacnaayaay

SEQ ID NO: 2511 - DNA, 18 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
acnaayaayaayacnaay

SEQ ID NO: 2512 - DNA, 18 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
acnaayaayaayaayacn

SEQ ID NO: 2513 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
aayacnacnaayaayaay

SEQ ID NO: 2514 - DNA, 18 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
aayacnaayacnaayaay

SEQ ID NO: 2515 - DNA, 18 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
aayacnaayaayacnaay

SEQ ID NO: 2516 - DNA, 18 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
aayacnaayaayaayacn

SEQ ID NO: 2517 - DNA, 18 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
aayaayacnacnaayaay

SEQ ID NO: 2518 - DNA, 18 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
aayaayacnaayacnaay

SEQ ID NO: 2519 - DNA, 18 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
aayaayacnaayaayacn

SEQ ID NO: 2520 - DNA, 18 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
aayaayaayacnacnaay

SEQ ID NO: 2521 - DNA, 18 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
aayaayaayacnaayacn

SEQ ID NO: 2522 - DNA, 21 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
  modified_base (21)..(21): a, c, g, t, unknown or other
aayaayaayaayacnacnacn

SEQ ID NO: 2523 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
acnacnacnaayaayaayaay

SEQ ID NO: 2524 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
acnaayacnacnaayaayaay

SEQ ID NO: 2525 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
acnaayacnaayacnaayaay

SEQ ID NO: 2526 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (18)..(18): a, c, g, t, unknown or other
acnaayacnaayaayacnaay

SEQ ID NO: 2527 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (21)..(21): a, c, g, t, unknown or other
acnaayacnaayaayaayacn

SEQ ID NO: 2528 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
acnaayaayacnacnaayaay

SEQ ID NO: 2529 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (18)..(18): a, c, g, t, unknown or other
acnaayaayacnaayacnaay

SEQ ID NO: 2530 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (21)..(21): a, c, g, t, unknown or other
acnaayaayacnaayaayacn

SEQ ID NO: 2531 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (21)..(21): a, c, g, t, unknown or other
acnaayaayaayacnaayacn

SEQ ID NO: 2532 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (18)..(18): a, c, g, t, unknown or other
acnaayaayaayacnacnaay

SEQ ID NO: 2533 - DNA, 21 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
  modified_base (21)..(21): a, c, g, t, unknown or other
acnaayaayaayaayacnacn

SEQ ID NO: 2534 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
acnacnaayacnaayaayaay

SEQ ID NO: 2535 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
acnacnaayaayacnaayaay

SEQ ID NO: 2536 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (18)..(18): a, c, g, t, unknown or other
acnacnaayaayaayacnaay

SEQ ID NO: 2537 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (21)..(21): a, c, g, t, unknown or other
acnacnaayaayaayaayacn

SEQ ID NO: 2538 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
aayacnacnacnaayaayaay

SEQ ID NO: 2539 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
aayacnacnaayacnaayaay

SEQ ID NO: 2540 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (18)..(18): a, c, g, t, unknown or other
aayacnacnaayaayacnaay

SEQ ID NO: 2541 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (21)..(21): a, c, g, t, unknown or other
aayacnacnaayaayaayacn

SEQ ID NO: 2542 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
aayacnaayacnacnaayaay

SEQ ID NO: 2543 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (18)..(18): a, c, g, t, unknown or other
aayacnaayaayacnacnaay

SEQ ID NO: 2544 - DNA, 21 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
  modified_base (21)..(21): a, c, g, t, unknown or other
aayacnaayaayaayacnacn

SEQ ID NO: 2545 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (18)..(18): a, c, g, t, unknown or other
aayacnaayacnaayacnaay

SEQ ID NO: 2546 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (21)..(21): a, c, g, t, unknown or other
aayacnaayacnaayaayacn

SEQ ID NO: 2547 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (21)..(21): a, c, g, t, unknown or other
aayacnaayaayacnaayacn

SEQ ID NO: 2548 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
aayaayacnacnacnaayaay

SEQ ID NO: 2549 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (18)..(18): a, c, g, t, unknown or other
aayaayacnacnaayacnaay

SEQ ID NO: 2550 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (21)..(21): a, c, g, t, unknown or other
aayaayacnacnaayaayacn

SEQ ID NO: 2551 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (18)..(18): a, c, g, t, unknown or other
aayaayacnaayacnacnaay

SEQ ID NO: 2552 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (21)..(21): a, c, g, t, unknown or other
aayaayacnaayacnaayacn

SEQ ID NO: 2553 - DNA, 21 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
  modified_base (21)..(21): a, c, g, t, unknown or other
aayaayacnaayaayacnacn

SEQ ID NO: 2554 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (18)..(18): a, c, g, t, unknown or other
aayaayaayacnacnacnaay

SEQ ID NO: 2555 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (21)..(21): a, c, g, t, unknown or other
aayaayaayacnacnaayacn

SEQ ID NO: 2556 - DNA, 21 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
  modified_base (21)..(21): a, c, g, t, unknown or other
aayaayaayacnaayacnacn

SEQ ID NO: 2557 - DNA, 21 bp, Artificial Sequence
  Description of Artificial Sequence: Synthetic oligonucleotide
  modified_base (18)..(18): a, c, g, t, unknown or other
  modified_base (21)..(21): a, c, g, t, unknown or other
aayaayaayaayaayacnacn

SEQ ID NO: 2558 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
acnacnaayaayaayaayaay

SEQ ID NO: 2559 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
acnaayacnaayaayaayaay

SEQ ID NO: 2560 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
acnaayaayacnaayaayaay

SEQ ID NO: 2561 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
acnaayaayaayacnaayaay

SEQ ID NO: 2562 - DNA, 21 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
acnaayaayaayaayacnaay

SEQ ID NO: 2563 - DNA, 21 bp, Artificial Sequence
  Description of Artificial Sequence: Synthetic oligonucleotide
  modified_base (3)..(3): a, c, g, t, unknown or other
  modified_base (21)..(21): a, c, g, t, unknown or other
acnaayaayaayaayaayacn

SEQ ID NO: 2564 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
aayacnacnaayaayaayaay

SEQ ID NO: 2565 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
aayacnaayacnaayaayaay

SEQ ID NO: 2566 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
aayacnaayaayacnaayaay

SEQ ID NO: 2567 - DNA, 21 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
aayacnaayaayaayacnaay

SEQ ID NO: 2568 - DNA, 21 bp, Artificial Sequence
  Description of Artificial Sequence: Synthetic oligonucleotide
  modified_base (6)..(6): a, c, g, t, unknown or other
  modified_base (21)..(21): a, c, g, t, unknown or other
aayacnaayaayaayaayacn

SEQ ID NO: 2569 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
aayaayacnacnaayaayaay

SEQ ID NO: 2570 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
aayaayacnaayacnaayaay

SEQ ID NO: 2571 - DNA, 21 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
aayaayacnaayaayacnaay

SEQ ID NO: 2572 - DNA, 21 bp, Artificial Sequence
  Description of Artificial Sequence: Synthetic oligonucleotide
  modified_base (9)..(9): a, c, g, t, unknown or other
  modified_base (21)..(21): a, c, g, t, unknown or other
aayaayacnaayaayaayacn

SEQ ID NO: 2573 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
aayaayaayacnacnaayaay

SEQ ID NO: 2574 - DNA, 21 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
aayaayaayacnaayacnaay

SEQ ID NO: 2575 - DNA, 21 bp, Artificial Sequence
  Description of Artificial Sequence: Synthetic oligonucleotide
  modified_base (12)..(12): a, c, g, t, unknown or other
  modified_base (21)..(21): a, c, g, t, unknown or other
aayaayaayacnaayaayacn

SEQ ID NO: 2576 - DNA, 21 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
aayaayaayaayacnacnaay

SEQ ID NO: 2577 - DNA, 21 bp, Artificial Sequence
  Description of Artificial Sequence: Synthetic oligonucleotide
  modified_base (15)..(15): a, c, g, t, unknown or other
  modified_base (21)..(21): a, c, g, t, unknown or other
aayaayaayaayacnaayacn

SEQ ID NO: 2578 - DNA, 21 bp, Artificial Sequence
  Description of Artificial Sequence: Synthetic oligonucleotide
  modified_base (21)..(21): a, c, g, t, unknown or other
aayaayaayaayaayaayacn

SEQ ID NO: 2579 - DNA, 21 bp, Artificial Sequence
  Description of Artificial Sequence: Synthetic oligonucleotide
  modified_base (3)..(3): a, c, g, t, unknown or other
acnaayaayaayaayaayaay

SEQ ID NO: 2580 - DNA, 21 bp, Artificial Sequence
  Description of Artificial Sequence: Synthetic oligonucleotide
  modified_base (6)..(6): a, c, g, t, unknown or other
aayacnaayaayaayaayaay

SEQ ID NO: 2581 - DNA, 21 bp, Artificial Sequence
  Description of Artificial Sequence: Synthetic oligonucleotide
  modified_base (9)..(9): a, c, g, t, unknown or other
aayaayacnaayaayaayaay

SEQ ID NO: 2582 - DNA, 21 bp, Artificial Sequence
  Description of Artificial Sequence: Synthetic oligonucleotide
  modified_base (12)..(12): a, c, g, t, unknown or other
aayaayaayacnaayaayaay

SEQ ID NO: 2583 - DNA, 21 bp, Artificial Sequence
  Description of Artificial Sequence: Synthetic oligonucleotide
  modified_base (15)..(15): a, c, g, t, unknown or other
aayaayaayaayacnaayaay

SEQ ID NO: 2584 - DNA, 21 bp, Artificial Sequence
  Description of Artificial Sequence: Synthetic oligonucleotide
  modified_base (18)..(18): a, c, g, t, unknown or other
aayaayaayaayaayacnaay

SEQ ID NO: 2585 - DNA, 12 bp, Artificial Sequence
  Description of Artificial Sequence: Synthetic oligonucleotide
  modified_base (12)..(12): a, c, g, t, unknown or other
aayaayaaygcn

SEQ ID NO: 2586 - DNA, 12 bp, Artificial Sequence
  Description of Artificial Sequence: Synthetic oligonucleotide
  modified_base (3)..(3): a, c, g, t, unknown or other
gcnaayaayaay

SEQ ID NO: 2587 - DNA, 12 bp, Artificial Sequence
  Description of Artificial Sequence: Synthetic oligonucleotide
  modified_base (6)..(6): a, c, g, t, unknown or other
aaygcnaayaay

SEQ ID NO: 2588 - DNA, 12 bp, Artificial Sequence
  Description of Artificial Sequence: Synthetic oligonucleotide
  modified_base (9)..(9): a, c, g, t, unknown or other
aayaaygcnaay

SEQ ID NO: 2589 - DNA, 15 bp, Artificial Sequence
  Description of Artificial Sequence: Synthetic oligonucleotide
  modified_base (15)..(15): a, c, g, t, unknown or other
aayaayaayaaygcn

SEQ ID NO: 2590 - DNA, 15 bp, Artificial Sequence
  Description of Artificial Sequence: Synthetic oligonucleotide
  modified_base (3)..(3): a, c, g, t, unknown or other
gcnaayaayaayaay

SEQ ID NO: 2591 - DNA, 15 bp, Artificial Sequence
  Description of Artificial Sequence: Synthetic oligonucleotide
  modified_base (6)..(6): a, c, g, t, unknown or other
aaygcnaayaayaay

SEQ ID NO: 2592 - DNA, 15 bp, Artificial Sequence
  Description of Artificial Sequence: Synthetic oligonucleotide
  modified_base (9)..(9): a, c, g, t, unknown or other
aayaaygcnaayaay

SEQ ID NO: 2593 - DNA, 15 bp, Artificial Sequence
  Description of Artificial Sequence: Synthetic oligonucleotide
  modified_base (12)..(12): a, c, g, t, unknown or other
aayaayaaygcnaay

SEQ ID NO: 2594 - DNA, 15 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
aayaayaaygcngcn

SEQ ID NO: 2595 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
gcngcnaayaayaay

SEQ ID NO: 2596 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
gcnaaygcnaayaay

SEQ ID NO: 2597 - DNA, 15 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
gcnaayaaygcnaay

SEQ ID NO: 2598 - DNA, 15 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
gcnaayaayaaygcn

SEQ ID NO: 2599 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
aaygcngcnaayaay

SEQ ID NO: 2600 - DNA, 15 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
aaygcnaaygcnaay

SEQ ID NO: 2601 - DNA, 15 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
aaygcnaayaaygcn

SEQ ID NO: 2602 - DNA, 15 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
aayaaygcngcnaay

SEQ ID NO: 2603 - DNA, 15 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
aayaaygcnaaygcn

SEQ ID NO: 2604 - DNA, 18 bp, Artificial Sequence
  Description of Artificial Sequence: Synthetic oligonucleotide
  modified_base (18)..(18): a, c, g, t, unknown or other
aayaayaayaayaaygcn

SEQ ID NO: 2605 - DNA, 18 bp, Artificial Sequence
  Description of Artificial Sequence: Synthetic oligonucleotide
  modified_base (3)..(3): a, c, g, t, unknown or other
gcnaayaayaayaayaay

SEQ ID NO: 2606 - DNA, 18 bp, Artificial Sequence
  Description of Artificial Sequence: Synthetic oligonucleotide
  modified_base (6)..(6): a, c, g, t, unknown or other
aaygcnaayaayaayaay

SEQ ID NO: 2607 - DNA, 18 bp, Artificial Sequence
  Description of Artificial Sequence: Synthetic oligonucleotide
  modified_base (9)..(9): a, c, g, t, unknown or other
aayaaygcnaayaayaay

SEQ ID NO: 2608 - DNA, 18 bp, Artificial Sequence
  Description of Artificial Sequence: Synthetic oligonucleotide
  modified_base (12)..(12): a, c, g, t, unknown or other
aayaayaaygcnaayaay

SEQ ID NO: 2609 - DNA, 18 bp, Artificial Sequence
  Description of Artificial Sequence: Synthetic oligonucleotide
  modified_base (15)..(15): a, c, g, t, unknown or other
aayaayaayaaygcnaay

SEQ ID NO: 2610 - DNA, 18 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
aayaayaayaaygcngcn

SEQ ID NO: 2611 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
gcngcnaayaayaayaay

SEQ ID NO: 2612 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
gcnaaygcnaayaayaay

SEQ ID NO: 2613 - DNA, 18 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
gcnaayaaygcnaayaay

SEQ ID NO: 2614 - DNA, 18 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
gcnaayaayaaygcnaay

SEQ ID NO: 2615 - DNA, 18 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
gcnaayaayaayaaygcn

SEQ ID NO: 2616 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
aaygcngcnaayaayaay

SEQ ID NO: 2617 - DNA, 18 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
aaygcnaaygcnaayaay

SEQ ID NO: 2618 - DNA, 18 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
aaygcnaayaaygcnaay

SEQ ID NO: 2619 - DNA, 18 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
aaygcnaayaayaaygcn

SEQ ID NO: 2620 - DNA, 18 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
aayaaygcngcnaayaay

SEQ ID NO: 2621 - DNA, 18 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
aayaaygcnaaygcnaay

SEQ ID NO: 2622 - DNA, 18 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
aayaaygcnaayaaygcn

SEQ ID NO: 2623 - DNA, 18 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
aayaayaaygcngcnaay

SEQ ID NO: 2624 - DNA, 18 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
aayaayaaygcnaaygcn

SEQ ID NO: 2625 - DNA, 21 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
  modified_base (21)..(21): a, c, g, t, unknown or other
aayaayaayaaygcngcngcn

SEQ ID NO: 2626 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
gcngcngcnaayaayaayaay

SEQ ID NO: 2627 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
gcnaaygcngcnaayaayaay

SEQ ID NO: 2628 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
gcnaaygcnaaygcnaayaay

SEQ ID NO: 2629 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (18)..(18): a, c, g, t, unknown or other
gcnaaygcnaayaaygcnaay

SEQ ID NO: 2630 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (21)..(21): a, c, g, t, unknown or other
gcnaaygcnaayaayaaygcn

SEQ ID NO: 2631 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
gcnaayaaygcngcnaayaay

SEQ ID NO: 2632 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (18)..(18): a, c, g, t, unknown or other
gcnaayaaygcnaaygcnaay

SEQ ID NO: 2633 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (21)..(21): a, c, g, t, unknown or other
gcnaayaaygcnaayaaygcn

SEQ ID NO: 2634 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (21)..(21): a, c, g, t, unknown or other
gcnaayaayaaygcnaaygcn

SEQ ID NO: 2635 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (18)..(18): a, c, g, t, unknown or other
gcnaayaayaaygcngcnaay

SEQ ID NO: 2636 - DNA, 21 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
  modified_base (21)..(21): a, c, g, t, unknown or other
gcnaayaayaayaaygcngcn

SEQ ID NO: 2637 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
gcngcnaaygcnaayaayaay

SEQ ID NO: 2638 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
gcngcnaayaaygcnaayaay

SEQ ID NO: 2639 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (18)..(18): a, c, g, t, unknown or other
gcngcnaayaayaaygcnaay

SEQ ID NO: 2640 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (21)..(21): a, c, g, t, unknown or other
gcngcnaayaayaayaaygcn

SEQ ID NO: 2641 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
aaygcngcngcnaayaayaay

SEQ ID NO: 2642 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
aaygcngcnaaygcnaayaay

SEQ ID NO: 2643 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (18)..(18): a, c, g, t, unknown or other
aaygcngcnaayaaygcnaay

SEQ ID NO: 2644 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (21)..(21): a, c, g, t, unknown or other
aaygcngcnaayaayaaygcn

SEQ ID NO: 2645 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
aaygcnaaygcngcnaayaay

SEQ ID NO: 2646 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (18)..(18): a, c, g, t, unknown or other
aaygcnaayaaygcngcnaay

SEQ ID NO: 2647 - DNA, 21 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
  modified_base (21)..(21): a, c, g, t, unknown or other
aaygcnaayaayaaygcngcn

SEQ ID NO: 2648 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (18)..(18): a, c, g, t, unknown or other
aaygcnaaygcnaaygcnaay

SEQ ID NO: 2649 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (21)..(21): a, c, g, t, unknown or other
aaygcnaaygcnaayaaygcn

SEQ ID NO: 2650 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (21)..(21): a, c, g, t, unknown or other
aaygcnaayaaygcnaaygcn

SEQ ID NO: 2651 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
aayaaygcngcngcnaayaay

SEQ ID NO: 2652 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (18)..(18): a, c, g, t, unknown or other
aayaaygcngcnaaygcnaay

SEQ ID NO: 2653 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (21)..(21): a, c, g, t, unknown or other
aayaaygcngcnaayaaygcn

SEQ ID NO: 2654 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (18)..(18): a, c, g, t, unknown or other
aayaaygcnaaygcngcnaay

SEQ ID NO: 2655 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (21)..(21): a, c, g, t, unknown or other
aayaaygcnaaygcnaaygcn

SEQ ID NO: 2656 - DNA, 21 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
  modified_base (21)..(21): a, c, g, t, unknown or other
aayaaygcnaayaaygcngcn

SEQ ID NO: 2657 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (18)..(18): a, c, g, t, unknown or other
aayaayaaygcngcngcnaay

SEQ ID NO: 2658 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (21)..(21): a, c, g, t, unknown or other
aayaayaaygcngcnaaygcn

SEQ ID NO: 2659 - DNA, 21 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
  modified_base (21)..(21): a, c, g, t, unknown or other
aayaayaaygcnaaygcngcn

SEQ ID NO: 2660 - DNA, 21 bp, Artificial Sequence
  Description of Artificial Sequence: Synthetic oligonucleotide
  modified_base (18)..(18): a, c, g, t, unknown or other
  modified_base (21)..(21): a, c, g, t, unknown or other
aayaayaayaayaaygcngcn

SEQ ID NO: 2661 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
gcngcnaayaayaayaayaay

SEQ ID NO: 2662 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
gcnaaygcnaayaayaayaay

SEQ ID NO: 2663 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
gcnaayaaygcnaayaayaay

SEQ ID NO: 2664 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
gcnaayaayaaygcnaayaay

SEQ ID NO: 2665 - DNA, 21 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
gcnaayaayaayaaygcnaay

SEQ ID NO: 2666 - DNA, 21 bp, Artificial Sequence
  Description of Artificial Sequence: Synthetic oligonucleotide
  modified_base (3)..(3): a, c, g, t, unknown or other
  modified_base (21)..(21): a, c, g, t, unknown or other
gcnaayaayaayaayaaygcn

SEQ ID NO: 2667 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
aaygcngcnaayaayaayaay

SEQ ID NO: 2668 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
aaygcnaaygcnaayaayaay

SEQ ID NO: 2669 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
aaygcnaayaaygcnaayaay

SEQ ID NO: 2670 - DNA, 21 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
aaygcnaayaayaaygcnaay

SEQ ID NO: 2671 - DNA, 21 bp, Artificial Sequence
  Description of Artificial Sequence: Synthetic oligonucleotide
  modified_base (6)..(6): a, c, g, t, unknown or other
  modified_base (21)..(21): a, c, g, t, unknown or other
aaygcnaayaayaayaaygcn

SEQ ID NO: 2672 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
aayaaygcngcnaayaayaay

SEQ ID NO: 2673 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
aayaaygcnaaygcnaayaay

SEQ ID NO: 2674 - DNA, 21 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
aayaaygcnaayaaygcnaay

SEQ ID NO: 2675 - DNA, 21 bp, Artificial Sequence
  Description of Artificial Sequence: Synthetic oligonucleotide
  modified_base (9)..(9): a, c, g, t, unknown or other
  modified_base (21)..(21): a, c, g, t, unknown or other
aayaaygcnaayaayaaygcn

SEQ ID NO: 2676 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
aayaayaaygcngcnaayaay

SEQ ID NO: 2677 - DNA, 21 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
aayaayaaygcnaaygcnaay

SEQ ID NO: 2678 - DNA, 21 bp, Artificial Sequence
  Description of Artificial Sequence: Synthetic oligonucleotide
  modified_base (12)..(12): a, c, g, t, unknown or other
  modified_base (21)..(21): a, c, g, t, unknown or other
aayaayaaygcnaayaaygcn

SEQ ID NO: 2679 - DNA, 21 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
aayaayaayaaygcngcnaay

SEQ ID NO: 2680 - DNA, 21 bp, Artificial Sequence
  Description of Artificial Sequence: Synthetic oligonucleotide
  modified_base (15)..(15): a, c, g, t, unknown or other
  modified_base (21)..(21): a, c, g, t, unknown or other
aayaayaayaaygcnaaygcn

SEQ ID NO: 2681 - DNA, 21 bp, Artificial Sequence
  Description of Artificial Sequence: Synthetic oligonucleotide
  modified_base (21)..(21): a, c, g, t, unknown or other
aayaayaayaayaayaaygcn

SEQ ID NO: 2682 - DNA, 21 bp, Artificial Sequence
  Description of Artificial Sequence: Synthetic oligonucleotide
  modified_base (3)..(3): a, c, g, t, unknown or other
gcnaayaayaayaayaayaay

SEQ ID NO: 2683 - DNA, 21 bp, Artificial Sequence
  Description of Artificial Sequence: Synthetic oligonucleotide
  modified_base (6)..(6): a, c, g, t, unknown or other
aaygcnaayaayaayaayaay

SEQ ID NO: 2684 - DNA, 21 bp, Artificial Sequence
  Description of Artificial Sequence: Synthetic oligonucleotide
  modified_base (9)..(9): a, c, g, t, unknown or other
aayaaygcnaayaayaayaay

SEQ ID NO: 2685 - DNA, 21 bp, Artificial Sequence
  Description of Artificial Sequence: Synthetic oligonucleotide
  modified_base (12)..(12): a, c, g, t, unknown or other
aayaayaaygcnaayaayaay

SEQ ID NO: 2686 - DNA, 21 bp, Artificial Sequence
  Description of Artificial Sequence: Synthetic oligonucleotide
  modified_base (15)..(15): a, c, g, t, unknown or other
aayaayaayaaygcnaayaay

SEQ ID NO: 2687 - DNA, 21 bp, Artificial Sequence
  Description of Artificial Sequence: Synthetic oligonucleotide
  modified_base (18)..(18): a, c, g, t, unknown or other
aayaayaayaayaaygcnaay

SEQ ID NO: 2688 - DNA, 12 bp, Artificial Sequence
  Description of Artificial Sequence: Synthetic oligonucleotide
aayaayaayagy

SEQ ID NO: 2689 - DNA, 12 bp, Artificial Sequence
  Description of Artificial Sequence: Synthetic oligonucleotide
agyaayaayaay

SEQ ID NO: 2690 - DNA, 12 bp, Artificial Sequence
  Description of Artificial Sequence: Synthetic oligonucleotide
aayagyaayaay

SEQ ID NO: 2691 - DNA, 12 bp, Artificial Sequence
  Description of Artificial Sequence: Synthetic oligonucleotide
aayaayagyaay

SEQ ID NO: 2692 - DNA, 15 bp, Artificial Sequence
  Description of Artificial Sequence: Synthetic oligonucleotide
aayaayaayaayagy

SEQ ID NO: 2693 - DNA, 15 bp, Artificial Sequence
  Description of Artificial Sequence: Synthetic oligonucleotide
agyaayaayaayaay

SEQ ID NO: 2694 - DNA, 15 bp, Artificial Sequence
  Description of Artificial Sequence: Synthetic oligonucleotide
aayagyaayaayaay

SEQ ID NO: 2695 - DNA, 15 bp, Artificial Sequence
  Description of Artificial Sequence: Synthetic oligonucleotide
aayaayagyaayaay

SEQ ID NO: 2696 - DNA, 15 bp, Artificial Sequence
  Description of Artificial Sequence: Synthetic oligonucleotide
aayaayaayagyaay

SEQ ID NO: 2697 - DNA, 15 bp, Artificial Sequence
  Description of Artificial Sequence: Synthetic oligonucleotide
aayaayaayagyagy

SEQ ID NO: 2698 - DNA, 15 bp, Artificial Sequence
  Description of Artificial Sequence: Synthetic oligonucleotide
agyagyaayaayaay

SEQ ID NO: 2699 - DNA, 15 bp, Artificial Sequence
  Description of Artificial Sequence: Synthetic oligonucleotide
agyaayagyaayaay

SEQ ID NO: 2700 - DNA, 15 bp, Artificial Sequence
  Description of Artificial Sequence: Synthetic oligonucleotide
agyaayaayagyaay

SEQ ID NO: 2701 - DNA, 15 bp, Artificial Sequence
  Description of Artificial Sequence: Synthetic oligonucleotide
agyaayaayaayagy

SEQ ID NO: 2702 - DNA, 15 bp, Artificial Sequence
  Description of Artificial Sequence: Synthetic oligonucleotide
aayagyagyaayaay

SEQ ID NO: 2703 - DNA, 15 bp, Artificial Sequence
  Description of Artificial Sequence: Synthetic oligonucleotide
aayagyaayagyaay

SEQ ID NO: 2704 - DNA, 15 bp, Artificial Sequence
  Description of Artificial Sequence: Synthetic oligonucleotide
aayagyaayaayagy

SEQ ID NO: 2705 - DNA, 15 bp, Artificial Sequence
  Description of Artificial Sequence: Synthetic oligonucleotide
aayaayagyagyaay

SEQ ID NO: 2706 - DNA, 15 bp, Artificial Sequence
  Description of Artificial Sequence: Synthetic oligonucleotide
aayaayagyaayagy

SEQ ID NO: 2707 - DNA, 18 bp, Artificial Sequence
  Description of Artificial Sequence: Synthetic oligonucleotide
aayaayaayaayaayagy

SEQ ID NO: 2708 - DNA, 18 bp, Artificial Sequence
  Description of Artificial Sequence: Synthetic oligonucleotide
agyaayaayaayaayaay

SEQ ID NO: 2709 - DNA, 18 bp, Artificial Sequence
  Description of Artificial Sequence: Synthetic oligonucleotide
aayagyaayaayaayaay

SEQ ID NO: 2710 - DNA, 18 bp, Artificial Sequence
  Description of Artificial Sequence: Synthetic oligonucleotide
aayaayagyaayaayaay

SEQ ID NO: 2711 - DNA, 18 bp, Artificial Sequence
  Description of Artificial Sequence: Synthetic oligonucleotide
aayaayaayagyaayaay

SEQ ID NO: 2712 - DNA, 18 bp, Artificial Sequence
  Description of Artificial Sequence: Synthetic oligonucleotide
aayaayaayaayagyaay

SEQ ID NO: 2713 - DNA, 18 bp, Artificial Sequence
  Description of Artificial Sequence: Synthetic oligonucleotide
aayaayaayaayagyagy

SEQ ID NO: 2714 - DNA, 18 bp, Artificial Sequence
  Description of Artificial Sequence: Synthetic oligonucleotide
agyagyaayaayaayaay

SEQ ID NO: 2715 - DNA, 18 bp, Artificial Sequence
  Description of Artificial Sequence: Synthetic oligonucleotide
agyaayagyaayaayaay

SEQ ID NO: 2716 - DNA, 18 bp, Artificial Sequence
  Description of Artificial Sequence: Synthetic oligonucleotide
agyaayaayagyaayaay

SEQ ID NO: 2717 - DNA, 18 bp, Artificial Sequence
  Description of Artificial Sequence: Synthetic oligonucleotide
agyaayaayaayagyaay

SEQ ID NO: 2718 - DNA, 18 bp, Artificial Sequence
  Description of Artificial Sequence: Synthetic oligonucleotide
agyaayaayaayaayagy

SEQ ID NO: 2719 - DNA, 18 bp, Artificial Sequence
  Description of Artificial Sequence: Synthetic oligonucleotide
aayagyagyaayaayaay

SEQ ID NO: 2720 - DNA, 18 bp, Artificial Sequence
  Description of Artificial Sequence: Synthetic oligonucleotide
aayagyaayagyaayaay

SEQ ID NO: 2721 - DNA, 18 bp, Artificial Sequence
  Description of Artificial Sequence: Synthetic oligonucleotide
aayagyaayaayagyaay

SEQ ID NO: 2722 - DNA, 18 bp, Artificial Sequence
  Description of Artificial Sequence: Synthetic oligonucleotide
aayagyaayaayaayagy

SEQ ID NO: 2723 - DNA, 18 bp, Artificial Sequence
  Description of Artificial Sequence: Synthetic oligonucleotide
aayaayagyagyaayaay

SEQ ID NO: 2724 - DNA, 18 bp, Artificial Sequence
  Description of Artificial Sequence: Synthetic oligonucleotide
aayaayagyaayagyaay

SEQ ID NO: 2725 - DNA, 18 bp, Artificial Sequence
  Description of Artificial Sequence: Synthetic oligonucleotide
aayaayagyaayaayagy

SEQ ID NO: 2726 - DNA, 18 bp, Artificial Sequence
  Description of Artificial Sequence: Synthetic oligonucleotide
aayaayaayagyagyaay

SEQ ID NO: 2727 - DNA, 18 bp, Artificial Sequence
  Description of Artificial Sequence: Synthetic oligonucleotide
aayaayaayagyaayagy

SEQ ID NO: 2728 - DNA, 21 bp, Artificial Sequence
  Description of Artificial Sequence: Synthetic oligonucleotide
aayaayaayaayagyagyagy

SEQ ID NO: 2729 - DNA, 21 bp, Artificial Sequence
  Description of Artificial Sequence: Synthetic oligonucleotide
agyagyagyaayaayaayaay

SEQ ID NO: 2730 - DNA, 21 bp, Artificial Sequence
  Description of Artificial Sequence: Synthetic oligonucleotide
agyaayagyagyaayaayaay

SEQ ID NO: 2731 - DNA, 21 bp, Artificial Sequence
  Description of Artificial Sequence: Synthetic oligonucleotide
agyaayagyaayagyaayaay

SEQ ID NO: 2732 - DNA, 21 bp, Artificial Sequence
  Description of Artificial Sequence: Synthetic oligonucleotide
agyaayagyaayaayagyaay

SEQ ID NO: 2733 - DNA, 21 bp, Artificial Sequence
  Description of Artificial Sequence: Synthetic oligonucleotide
agyaayagyaayaayaayagy

SEQ ID NO: 2734 - DNA, 21 bp, Artificial Sequence
  Description of Artificial Sequence: Synthetic oligonucleotide
agyaayaayagyagyaayaay

SEQ ID NO: 2735 - DNA, 21 bp, Artificial Sequence
  Description of Artificial Sequence: Synthetic oligonucleotide
agyaayaayagyaayagyaay

SEQ ID NO: 2736 - DNA, 21 bp, Artificial Sequence
  Description of Artificial Sequence: Synthetic oligonucleotide
agyaayaayagyaayaayagy

SEQ ID NO: 2737 - DNA, 21 bp, Artificial Sequence
  Description of Artificial Sequence: Synthetic oligonucleotide
agyaayaayaayagyaayagy

SEQ ID NO: 2738 - DNA, 21 bp, Artificial Sequence
  Description of Artificial Sequence: Synthetic oligonucleotide
agyaayaayaayagyagyaay

SEQ ID NO: 2739 - DNA, 21 bp, Artificial Sequence
  Description of Artificial Sequence: Synthetic oligonucleotide
agyaayaayaayaayagyagy

SEQ ID NO: 2740 - DNA, 21 bp, Artificial Sequence
  Description of Artificial Sequence: Synthetic oligonucleotide
agyagyaayagyaayaayaay

SEQ ID NO: 2741 - DNA, 21 bp, Artificial Sequence
  Description of Artificial Sequence: Synthetic oligonucleotide
agyagyaayaayagyaayaay

SEQ ID NO: 2742 - DNA, 21 bp, Artificial Sequence
  Description of Artificial Sequence: Synthetic oligonucleotide
agyagyaayaayaayagyaay

SEQ ID NO: 2743 - DNA, 21 bp, Artificial Sequence
  Description of Artificial Sequence: Synthetic oligonucleotide
agyagyaayaayaayaayagy

SEQ ID NO: 2744 - DNA, 21 bp, Artificial Sequence
  Description of Artificial Sequence: Synthetic oligonucleotide
aayagyagyagyaayaayaay

SEQ ID NO: 2745 - DNA, 21 bp, Artificial Sequence
  Description of Artificial Sequence: Synthetic oligonucleotide
aayagyagyaayagyaayaay

SEQ ID NO: 2746 - DNA, 21 bp, Artificial Sequence
  Description of Artificial Sequence: Synthetic oligonucleotide
aayagyagyaayaayagyaay

SEQ ID NO: 2747 - DNA, 21 bp, Artificial Sequence
  Description of Artificial Sequence: Synthetic oligonucleotide
aayagyagyaayaayaayagy

SEQ ID NO: 2748 - DNA, 21 bp, Artificial Sequence
  Description of Artificial Sequence: Synthetic oligonucleotide
aayagyaayagyagyaayaay

SEQ ID NO: 2749 - DNA, 21 bp, Artificial Sequence
  Description of Artificial Sequence: Synthetic oligonucleotide
aayagyaayaayagyagyaay

SEQ ID NO: 2750 - DNA, 21 bp, Artificial Sequence
  Description of Artificial Sequence: Synthetic oligonucleotide
aayagyaayaayaayagyagy

SEQ ID NO: 2751 - DNA, 21 bp, Artificial Sequence
  Description of Artificial Sequence: Synthetic oligonucleotide
aayagyaayagyaayagyaay

SEQ ID NO: 2752 - DNA, 21 bp, Artificial Sequence
  Description of Artificial Sequence: Synthetic oligonucleotide
aayagyaayagyaayaayagy

SEQ ID NO: 2753 - DNA, 21 bp, Artificial Sequence
  Description of Artificial Sequence: Synthetic oligonucleotide
aayagyaayaayagyaayagy

SEQ ID NO: 2754 - DNA, 21 bp, Artificial Sequence
  Description of Artificial Sequence: Synthetic oligonucleotide
aayaayagyagyagyaayaay

SEQ ID NO: 2755 - DNA, 21 bp, Artificial Sequence
  Description of Artificial Sequence: Synthetic oligonucleotide
aayaayagyagyaayagyaay

SEQ ID NO: 2756 - DNA, 21 bp, Artificial Sequence
  Description of Artificial Sequence: Synthetic oligonucleotide
aayaayagyagyaayaayagy

SEQ ID NO: 2757 - DNA, 21 bp, Artificial Sequence
  Description of Artificial Sequence: Synthetic oligonucleotide
aayaayagyaayagyagyaay

SEQ ID NO: 2758 - DNA, 21 bp, Artificial Sequence
  Description of Artificial Sequence: Synthetic oligonucleotide
aayaayagyaayagyaayagy

SEQ ID NO: 2759 - DNA, 21 bp, Artificial Sequence
  Description of Artificial Sequence: Synthetic oligonucleotide
aayaayagyaayaayagyagy

SEQ ID NO: 2760 - DNA, 21 bp, Artificial Sequence
  Description of Artificial Sequence: Synthetic oligonucleotide
aayaayaayagyagyagyaay

SEQ ID NO: 2761 - DNA, 21 bp, Artificial Sequence
  Description of Artificial Sequence: Synthetic oligonucleotide
aayaayaayagyagyaayagy

SEQ ID NO: 2762 - DNA, 21 bp, Artificial Sequence
  Description of Artificial Sequence: Synthetic oligonucleotide
aayaayaayagyaayagyagy

SEQ ID NO: 2763 - DNA, 21 bp, Artificial Sequence
  Description of Artificial Sequence: Synthetic oligonucleotide
aayaayaayaayaayagyagy

SEQ ID NO: 2764 - DNA, 21 bp, Artificial Sequence
  Description of Artificial Sequence: Synthetic oligonucleotide
agyagyaayaayaayaayaay

SEQ ID NO: 2765 - DNA, 21 bp, Artificial Sequence
  Description of Artificial Sequence: Synthetic oligonucleotide
agyaayagyaayaayaayaay

SEQ ID NO: 2766 - DNA, 21 bp, Artificial Sequence
  Description of Artificial Sequence: Synthetic oligonucleotide
agyaayaayagyaayaayaay

SEQ ID NO: 2767 - DNA, 21 bp, Artificial Sequence
  Description of Artificial Sequence: Synthetic oligonucleotide
agyaayaayaayagyaayaay

SEQ ID NO: 2768 - DNA, 21 bp, Artificial Sequence
  Description of Artificial Sequence: Synthetic oligonucleotide
agyaayaayaayaayagyaay

SEQ ID NO: 2769 - DNA, 21 bp, Artificial Sequence
  Description of Artificial Sequence: Synthetic oligonucleotide
agyaayaayaayaayaayagy

SEQ ID NO: 2770 - DNA, 21 bp, Artificial Sequence
  Description of Artificial Sequence: Synthetic oligonucleotide
aayagyagyaayaayaayaay

SEQ ID NO: 2771 - DNA, 21 bp, Artificial Sequence
  Description of Artificial Sequence: Synthetic oligonucleotide
aayagyaayagyaayaayaay

SEQ ID NO: 2772 - DNA, 21 bp, Artificial Sequence
  Description of Artificial Sequence: Synthetic oligonucleotide
aayagyaayaayagyaayaay

SEQ ID NO: 2773 - DNA, 21 bp, Artificial Sequence
  Description of Artificial Sequence: Synthetic oligonucleotide
aayagyaayaayaayagyaay

SEQ ID NO: 2774 - DNA, 21 bp, Artificial Sequence
  Description of Artificial Sequence: Synthetic oligonucleotide
aayagyaayaayaayaayagy

SEQ ID NO: 2775 - DNA, 21 bp, Artificial Sequence
  Description of Artificial Sequence: Synthetic oligonucleotide
aayaayagyagyaayaayaay

SEQ ID NO: 2776 - DNA, 21 bp, Artificial Sequence
  Description of Artificial Sequence: Synthetic oligonucleotide
aayaayagyaayagyaayaay

SEQ ID NO: 2777 - DNA, 21 bp, Artificial Sequence
  Description of Artificial Sequence: Synthetic oligonucleotide
aayaayagyaayaayagyaay

SEQ ID NO: 2778 - DNA, 21 bp, Artificial Sequence
  Description of Artificial Sequence: Synthetic oligonucleotide
aayaayagyaayaayaayagy

SEQ ID NO: 2779 - DNA, 21 bp, Artificial Sequence
  Description of Artificial Sequence: Synthetic oligonucleotide
aayaayaayagyagyaayaay

SEQ ID NO: 2780 - DNA, 21 bp, Artificial Sequence
  Description of Artificial Sequence: Synthetic oligonucleotide
aayaayaayagyaayagyaay

SEQ ID NO: 2781 - DNA, 21 bp, Artificial Sequence
  Description of Artificial Sequence: Synthetic oligonucleotide
aayaayaayagyaayaayagy

SEQ ID NO: 2782 - DNA, 21 bp, Artificial Sequence
  Description of Artificial Sequence: Synthetic oligonucleotide
aayaayaayaayagyagyaay

SEQ ID NO: 2783 - DNA, 21 bp, Artificial Sequence
  Description of Artificial Sequence: Synthetic oligonucleotide
aayaayaayaayagyaayagy

SEQ ID NO: 2784 - DNA, 21 bp, Artificial Sequence
  Description of Artificial Sequence: Synthetic oligonucleotide
aayaayaayaayaayaayagy

SEQ ID NO: 2785 - DNA, 21 bp, Artificial Sequence
  Description of Artificial Sequence: Synthetic oligonucleotide
agyaayaayaayaayaayaay

SEQ ID NO: 2786 - DNA, 21 bp, Artificial Sequence
  Description of Artificial Sequence: Synthetic oligonucleotide
aayagyaayaayaayaayaay

SEQ ID NO: 2787 - DNA, 21 bp, Artificial Sequence
  Description of Artificial Sequence: Synthetic oligonucleotide
aayaayagyaayaayaayaay

SEQ ID NO: 2788 - DNA, 21 bp, Artificial Sequence
  Description of Artificial Sequence: Synthetic oligonucleotide
aayaayaayagyaayaayaay

SEQ ID NO: 2789 - DNA, 21 bp, Artificial Sequence
  Description of Artificial Sequence: Synthetic oligonucleotide
aayaayaayaayagyaayaay

SEQ ID NO: 2790 - DNA, 21 bp, Artificial Sequence
  Description of Artificial Sequence: Synthetic oligonucleotide
aayaayaayaayaayagyaay

SEQ ID NO: 2791 - DNA, 12 bp, Artificial Sequence
  Description of Artificial Sequence: Synthetic oligonucleotide
aayaayaaycar

SEQ ID NO: 2792 - DNA, 12 bp, Artificial Sequence
  Description of Artificial Sequence: Synthetic oligonucleotide
caraayaayaay

SEQ ID NO: 2793 - DNA, 12 bp, Artificial Sequence
  Description of Artificial Sequence: Synthetic oligonucleotide
aaycaraayaay

SEQ ID NO: 2794 - DNA, 12 bp, Artificial Sequence
  Description of Artificial Sequence: Synthetic oligonucleotide
aayaaycaraay

SEQ ID NO: 2795 - DNA, 15 bp, Artificial Sequence
  Description of Artificial Sequence: Synthetic oligonucleotide
aayaayaayaaycar

SEQ ID NO: 2796 - DNA, 15 bp, Artificial Sequence
  Description of Artificial Sequence: Synthetic oligonucleotide
caraayaayaayaay

SEQ ID NO: 2797 - DNA, 15 bp, Artificial Sequence
  Description of Artificial Sequence: Synthetic oligonucleotide
aaycaraayaayaay

SEQ ID NO: 2798 - DNA, 15 bp, Artificial Sequence
  Description of Artificial Sequence: Synthetic oligonucleotide
aayaaycaraayaay

SEQ ID NO: 2799 - DNA, 15 bp, Artificial Sequence
  Description of Artificial Sequence: Synthetic oligonucleotide
aayaayaaycaraay

SEQ ID NO: 2800 - DNA, 15 bp, Artificial Sequence
  Description of Artificial Sequence: Synthetic oligonucleotide
aayaayaaycarcar

SEQ ID NO: 2801 - DNA, 15 bp, Artificial Sequence
  Description of Artificial Sequence: Synthetic oligonucleotide
carcaraayaayaay

SEQ ID NO: 2802 - DNA, 15 bp, Artificial Sequence
  Description of Artificial Sequence: Synthetic oligonucleotide
caraaycaraayaay

SEQ ID NO: 2803 - DNA, 15 bp, Artificial Sequence
  Description of Artificial Sequence: Synthetic oligonucleotide
caraayaaycaraay

SEQ ID NO: 2804 - DNA, 15 bp, Artificial Sequence
  Description of Artificial Sequence: Synthetic oligonucleotide
caraayaayaaycar

SEQ ID NO: 2805 - DNA, 15 bp, Artificial Sequence
  Description of Artificial Sequence: Synthetic oligonucleotide
aaycarcaraayaay

SEQ ID NO: 2806 - DNA, 15 bp, Artificial Sequence
  Description of Artificial Sequence: Synthetic oligonucleotide
aaycaraaycaraay

SEQ ID NO: 2807 - DNA, 15 bp, Artificial Sequence
  Description of Artificial Sequence: Synthetic oligonucleotide
aaycaraayaaycar

SEQ ID NO: 2808 - DNA, 15 bp, Artificial Sequence
  Description of Artificial Sequence: Synthetic oligonucleotide
aayaaycarcaraay

SEQ ID NO: 2809 - DNA, 15 bp, Artificial Sequence
  Description of Artificial Sequence: Synthetic oligonucleotide
aayaaycaraaycar

SEQ ID NO: 2810 - DNA, 18 bp, Artificial Sequence
  Description of Artificial Sequence: Synthetic oligonucleotide
aayaayaayaayaaycar

SEQ ID NO: 2811 - DNA, 18 bp, Artificial Sequence
  Description of Artificial Sequence: Synthetic oligonucleotide
caraayaayaayaayaay

SEQ ID NO: 2812 - DNA, 18 bp, Artificial Sequence
  Description of Artificial Sequence: Synthetic oligonucleotide
aaycaraayaayaayaay

SEQ ID NO: 2813 - DNA, 18 bp, Artificial Sequence
  Description of Artificial Sequence: Synthetic oligonucleotide
aayaaycaraayaayaay

SEQ ID NO: 2814 - DNA, 18 bp, Artificial Sequence
  Description of Artificial Sequence: Synthetic oligonucleotide
aayaayaaycaraayaay

SEQ ID NO: 2815 - DNA, 18 bp, Artificial Sequence
  Description of Artificial Sequence: Synthetic oligonucleotide
aayaayaayaaycaraay

SEQ ID NO: 2816 - DNA, 18 bp, Artificial Sequence
  Description of Artificial Sequence: Synthetic oligonucleotide
aayaayaayaaycarcar

SEQ ID NO: 2817 - DNA, 18 bp, Artificial Sequence
  Description of Artificial Sequence: Synthetic oligonucleotide
carcaraayaayaayaay

SEQ ID NO: 2818 - DNA, 18 bp, Artificial Sequence
  Description of Artificial Sequence: Synthetic oligonucleotide
caraaycaraayaayaay

SEQ ID NO: 2819 - DNA, 18 bp, Artificial Sequence
  Description of Artificial Sequence: Synthetic oligonucleotide
caraayaaycaraayaay

SEQ ID NO: 2820 - DNA, 18 bp, Artificial Sequence
  Description of Artificial Sequence: Synthetic oligonucleotide
caraayaayaaycaraay

SEQ ID NO: 2821 - DNA, 18 bp, Artificial Sequence
  Description of Artificial Sequence: Synthetic oligonucleotide
caraayaayaayaaycar

SEQ ID NO: 2822 - DNA, 18 bp, Artificial Sequence
  Description of Artificial Sequence: Synthetic oligonucleotide
aaycarcaraayaayaay

SEQ ID NO: 2823 - DNA, 18 bp, Artificial Sequence
  Description of Artificial Sequence: Synthetic oligonucleotide
aaycaraaycaraayaay

SEQ ID NO: 2824 - DNA, 18 bp, Artificial Sequence
  Description of Artificial Sequence: Synthetic oligonucleotide
aaycaraayaaycaraay

SEQ ID NO: 2825 - DNA, 18 bp, Artificial Sequence
  Description of Artificial Sequence: Synthetic oligonucleotide
aaycaraayaayaaycar

SEQ ID NO: 2826 - DNA, 18 bp, Artificial Sequence
  Description of Artificial Sequence: Synthetic oligonucleotide
aayaaycarcaraayaay

SEQ ID NO: 2827 - DNA, 18 bp, Artificial Sequence
  Description of Artificial Sequence: Synthetic oligonucleotide
aayaaycaraaycaraay

SEQ ID NO: 2828 - DNA, 18 bp, Artificial Sequence
  Description of Artificial Sequence: Synthetic oligonucleotide
aayaaycaraayaaycar

SEQ ID NO: 2829 - DNA, 18 bp, Artificial Sequence
  Description of Artificial Sequence: Synthetic oligonucleotide
aayaayaaycarcaraay

SEQ ID NO: 2830 - DNA, 18 bp, Artificial Sequence
  Description of Artificial Sequence: Synthetic oligonucleotide
aayaayaaycaraaycar

SEQ ID NO: 2831 - DNA, 21 bp, Artificial Sequence
  Description of Artificial Sequence: Synthetic oligonucleotide
aayaayaayaaycarcarcar

SEQ ID NO: 2832 - DNA, 21 bp, Artificial Sequence
  Description of Artificial Sequence: Synthetic oligonucleotide
carcarcaraayaayaayaay

SEQ ID NO: 2833 - DNA, 21 bp, Artificial Sequence
  Description of Artificial Sequence: Synthetic oligonucleotide
caraaycarcaraayaayaay

SEQ ID NO: 2834 - DNA, 21 bp, Artificial Sequence
  Description of Artificial Sequence: Synthetic oligonucleotide
caraaycaraaycaraayaay

SEQ ID NO: 2835 - DNA, 21 bp, Artificial Sequence
  Description of Artificial Sequence: Synthetic oligonucleotide
caraaycaraayaaycaraay

SEQ ID NO: 2836 - DNA, 21 bp, Artificial Sequence
  Description of Artificial Sequence: Synthetic oligonucleotide
caraaycaraayaayaaycar

SEQ ID NO: 2837 - DNA, 21 bp, Artificial Sequence
  Description of Artificial Sequence: Synthetic oligonucleotide
caraayaaycarcaraayaay

SEQ ID NO: 2838 - DNA, 21 bp, Artificial Sequence
  Description of Artificial Sequence: Synthetic oligonucleotide
caraayaaycaraaycaraay

SEQ ID NO: 2839 - DNA, 21 bp, Artificial Sequence
  Description of Artificial Sequence: Synthetic oligonucleotide
caraayaaycaraayaaycar

SEQ ID NO: 2840 - DNA, 21 bp, Artificial Sequence
  Description of Artificial Sequence: Synthetic oligonucleotide
caraayaayaaycaraaycar

SEQ ID NO: 2841 - DNA, 21 bp, Artificial Sequence
  Description of Artificial Sequence: Synthetic oligonucleotide
caraayaayaaycarcaraay

SEQ ID NO: 2842 - DNA, 21 bp, Artificial Sequence
  Description of Artificial Sequence: Synthetic oligonucleotide
caraayaayaayaaycarcar

SEQ ID NO: 2843 - DNA, 21 bp, Artificial Sequence
  Description of Artificial Sequence: Synthetic oligonucleotide
carcaraaycaraayaayaay

SEQ ID NO: 2844 - DNA, 21 bp, Artificial Sequence
  Description of Artificial Sequence: Synthetic oligonucleotide
carcaraayaaycaraayaay

SEQ ID NO: 2845 - DNA, 21 bp, Artificial Sequence
  Description of Artificial Sequence: Synthetic oligonucleotide
carcaraayaayaaycaraay

SEQ ID NO: 2846 - DNA, 21 bp, Artificial Sequence
  Description of Artificial Sequence: Synthetic oligonucleotide
carcaraayaayaayaaycar

SEQ ID NO: 2847 - DNA, 21 bp, Artificial Sequence
  Description of Artificial Sequence: Synthetic oligonucleotide
aaycarcarcaraayaayaay

SEQ ID NO: 2848 - DNA, 21 bp, Artificial Sequence
  Description of Artificial Sequence: Synthetic oligonucleotide
aaycarcaraaycaraayaay

SEQ ID NO: 2849 - DNA, 21 bp, Artificial Sequence
  Description of Artificial Sequence: Synthetic oligonucleotide
aaycarcaraayaaycaraay

SEQ ID NO: 2850 - DNA, 21 bp, Artificial Sequence
  Description of Artificial Sequence: Synthetic oligonucleotide
aaycarcaraayaayaaycar

SEQ ID NO: 2851 - DNA, 21 bp, Artificial Sequence
  Description of Artificial Sequence: Synthetic oligonucleotide
aaycaraaycarcaraayaay

SEQ ID NO: 2852 - DNA, 21 bp, Artificial Sequence
  Description of Artificial Sequence: Synthetic oligonucleotide
aaycaraayaaycarcaraay

SEQ ID NO: 2853 - DNA, 21 bp, Artificial Sequence
  Description of Artificial Sequence: Synthetic oligonucleotide
aaycaraayaayaaycarcar

SEQ ID NO: 2854 - DNA, 21 bp, Artificial Sequence
  Description of Artificial Sequence: Synthetic oligonucleotide
aaycaraaycaraaycaraay

SEQ ID NO: 2855 - DNA, 21 bp, Artificial Sequence
  Description of Artificial Sequence: Synthetic oligonucleotide
aaycaraaycaraayaaycar

SEQ ID NO: 2856 - DNA, 21 bp, Artificial Sequence
  Description of Artificial Sequence: Synthetic oligonucleotide
aaycaraayaaycaraaycar

SEQ ID NO: 2857 - DNA, 21 bp, Artificial Sequence
  Description of Artificial Sequence: Synthetic oligonucleotide
aayaaycarcarcaraayaay

SEQ ID NO: 2858 - DNA, 21 bp, Artificial Sequence
  Description of Artificial Sequence: Synthetic oligonucleotide
aayaaycarcaraaycaraay

SEQ ID NO: 2859 - DNA, 21 bp, Artificial Sequence
  Description of Artificial Sequence: Synthetic oligonucleotide
aayaaycarcaraayaaycar

SEQ ID NO: 2860 - DNA, 21 bp, Artificial Sequence
  Description of Artificial Sequence: Synthetic oligonucleotide
aayaaycaraaycarcaraay

SEQ ID NO: 2861 - DNA, 21 bp, Artificial Sequence
  Description of Artificial Sequence: Synthetic oligonucleotide
aayaaycaraaycaraaycar

SEQ ID NO: 2862 - DNA, 21 bp, Artificial Sequence
  Description of Artificial Sequence: Synthetic oligonucleotide
aayaaycaraayaaycarcar

SEQ ID NO: 2863 - DNA, 21 bp, Artificial Sequence
  Description of Artificial Sequence: Synthetic oligonucleotide
aayaayaaycarcarcaraay

SEQ ID NO: 2864 - DNA, 21 bp, Artificial Sequence
  Description of Artificial Sequence: Synthetic oligonucleotide
aayaayaaycarcaraaycar

SEQ ID NO: 2865 - DNA, 21 bp, Artificial Sequence
  Description of Artificial Sequence: Synthetic oligonucleotide
aayaayaaycaraaycarcar

SEQ ID NO: 2866 - DNA, 21 bp, Artificial Sequence
  Description of Artificial Sequence: Synthetic oligonucleotide
aayaayaayaayaaycarcar

SEQ ID NO: 2867 - DNA, 21 bp, Artificial Sequence
  Description of Artificial Sequence: Synthetic oligonucleotide
carcaraayaayaayaayaay

SEQ ID NO: 2868 - DNA, 21 bp, Artificial Sequence
  Description of Artificial Sequence: Synthetic oligonucleotide
caraaycaraayaayaayaay

SEQ ID NO: 2869 - DNA, 21 bp, Artificial Sequence
  Description of Artificial Sequence: Synthetic oligonucleotide
caraayaaycaraayaayaay

SEQ ID NO: 2870 - DNA, 21 bp, Artificial Sequence
  Description of Artificial Sequence: Synthetic oligonucleotide
caraayaayaaycaraayaay

SEQ ID NO: 2871 - DNA, 21 bp, Artificial Sequence
  Description of Artificial Sequence: Synthetic oligonucleotide
caraayaayaayaaycaraay

SEQ ID NO: 2872 - DNA, 21 bp, Artificial Sequence
  Description of Artificial Sequence: Synthetic oligonucleotide
caraayaayaayaayaaycar

SEQ ID NO: 2873 - DNA, 21 bp, Artificial Sequence
  Description of Artificial Sequence: Synthetic oligonucleotide
aaycarcaraayaayaayaay

SEQ ID NO: 2874 - DNA, 21 bp, Artificial Sequence
  Description of Artificial Sequence: Synthetic oligonucleotide
aaycaraaycaraayaayaay

SEQ ID NO: 2875 - DNA, 21 bp, Artificial Sequence
  Description of Artificial Sequence: Synthetic oligonucleotide
aaycaraayaaycaraayaay

SEQ ID NO: 2876 - DNA, 21 bp, Artificial Sequence
  Description of Artificial Sequence: Synthetic oligonucleotide
aaycaraayaayaaycaraay

SEQ ID NO: 2877 - DNA, 21 bp, Artificial Sequence
  Description of Artificial Sequence: Synthetic oligonucleotide
aaycaraayaayaayaaycar

SEQ ID NO: 2878 - DNA, 21 bp, Artificial Sequence
  Description of Artificial Sequence: Synthetic oligonucleotide
aayaaycarcaraayaayaay

SEQ ID NO: 2879 - DNA, 21 bp, Artificial Sequence
  Description of Artificial Sequence: Synthetic oligonucleotide
aayaaycaraaycaraayaay

SEQ ID NO: 2880 - DNA, 21 bp, Artificial Sequence
  Description of Artificial Sequence: Synthetic oligonucleotide
aayaaycaraayaaycaraay

SEQ ID NO: 2881 - DNA, 21 bp, Artificial Sequence
  Description of Artificial Sequence: Synthetic oligonucleotide
aayaaycaraayaayaaycar

SEQ ID NO: 2882 - DNA, 21 bp, Artificial Sequence
  Description of Artificial Sequence: Synthetic oligonucleotide
aayaayaaycarcaraayaay

SEQ ID NO: 2883 - DNA, 21 bp, Artificial Sequence
  Description of Artificial Sequence: Synthetic oligonucleotide
aayaayaaycaraaycaraay

SEQ ID NO: 2884 - DNA, 21 bp, Artificial Sequence
  Description of Artificial Sequence: Synthetic oligonucleotide
aayaayaaycaraayaaycar

SEQ ID NO: 2885 - DNA, 21 bp, Artificial Sequence
  Description of Artificial Sequence: Synthetic oligonucleotide
aayaayaayaaycarcaraay

SEQ ID NO: 2886 - DNA, 21 bp, Artificial Sequence
  Description of Artificial Sequence: Synthetic oligonucleotide
aayaayaayaaycaraaycar

SEQ ID NO: 2887 - DNA, 21 bp, Artificial Sequence
  Description of Artificial Sequence: Synthetic oligonucleotide
aayaayaayaayaayaaycar

SEQ ID NO: 2888 - DNA, 21 bp, Artificial Sequence
  Description of Artificial Sequence: Synthetic oligonucleotide
caraayaayaayaayaayaay

SEQ ID NO: 2889 - DNA, 21 bp, Artificial Sequence
  Description of Artificial Sequence: Synthetic oligonucleotide
aaycaraayaayaayaayaay

SEQ ID NO: 2890 - DNA, 21 bp, Artificial Sequence
  Description of Artificial Sequence: Synthetic oligonucleotide
aayaaycaraayaayaayaay

SEQ ID NO: 2891 - DNA, 21 bp, Artificial Sequence
  Description of Artificial Sequence: Synthetic oligonucleotide
aayaayaaycaraayaayaay

SEQ ID NO: 2892 - DNA, 21 bp, Artificial Sequence
  Description of Artificial Sequence: Synthetic oligonucleotide
aayaayaayaaycaraayaay

SEQ ID NO: 2893 - DNA, 21 bp, Artificial Sequence
  Description of Artificial Sequence: Synthetic oligonucleotide
aayaayaayaayaaycaraay

SEQ ID NO: 2894 - DNA, 12 bp, Artificial Sequence
  Description of Artificial Sequence: Synthetic oligonucleotide
aayaayaaygar

SEQ ID NO: 2895 - DNA, 12 bp, Artificial Sequence
  Description of Artificial Sequence: Synthetic oligonucleotide
garaayaayaay

SEQ ID NO: 2896 - DNA, 12 bp, Artificial Sequence
  Description of Artificial Sequence: Synthetic oligonucleotide
aaygaraayaay

SEQ ID NO: 2897 - DNA, 12 bp, Artificial Sequence
  Description of Artificial Sequence: Synthetic oligonucleotide
aayaaygaraay

SEQ ID NO: 2898 - DNA, 15 bp, Artificial Sequence
  Description of Artificial Sequence: Synthetic oligonucleotide
aayaayaayaaygar

SEQ ID NO: 2899 - DNA, 15 bp, Artificial Sequence
  Description of Artificial Sequence: Synthetic oligonucleotide
garaayaayaayaay

SEQ ID NO: 2900 - DNA, 15 bp, Artificial Sequence
  Description of Artificial Sequence: Synthetic oligonucleotide
aaygaraayaayaay

SEQ ID NO: 2901 - DNA, 15 bp, Artificial Sequence
  Description of Artificial Sequence: Synthetic oligonucleotide
aayaaygaraayaay

SEQ ID NO: 2902 - DNA, 15 bp, Artificial Sequence
  Description of Artificial Sequence: Synthetic oligonucleotide
aayaayaaygaraay

SEQ ID NO: 2903 - DNA, 15 bp, Artificial Sequence
  Description of Artificial Sequence: Synthetic oligonucleotide
aayaayaaygargar

SEQ ID NO: 2904 - DNA, 15 bp, Artificial Sequence
  Description of Artificial Sequence: Synthetic oligonucleotide
gargaraayaayaay

SEQ ID NO: 2905 - DNA, 15 bp, Artificial Sequence
  Description of Artificial Sequence: Synthetic oligonucleotide
garaaygaraayaay

SEQ ID NO: 2906 - DNA, 15 bp, Artificial Sequence
  Description of Artificial Sequence: Synthetic oligonucleotide
garaayaaygaraay

SEQ ID NO: 2907 - DNA, 15 bp, Artificial Sequence
  Description of Artificial Sequence: Synthetic oligonucleotide
garaayaayaaygar

SEQ ID NO: 2908 - DNA, 15 bp, Artificial Sequence
  Description of Artificial Sequence: Synthetic oligonucleotide
aaygargaraayaay

SEQ ID NO: 2909 - DNA, 15 bp, Artificial Sequence
  Description of Artificial Sequence: Synthetic oligonucleotide
aaygaraaygaraay

SEQ ID NO: 2910 - DNA, 15 bp, Artificial Sequence
  Description of Artificial Sequence: Synthetic oligonucleotide
aaygaraayaaygar

SEQ ID NO: 2911 - DNA, 15 bp, Artificial Sequence
  Description of Artificial Sequence: Synthetic oligonucleotide
aayaaygargaraay

SEQ ID NO: 2912 - DNA, 15 bp, Artificial Sequence
  Description of Artificial Sequence: Synthetic oligonucleotide
aayaaygaraaygar

SEQ ID NO: 2913 - DNA, 18 bp, Artificial Sequence
  Description of Artificial Sequence: Synthetic oligonucleotide
aayaayaayaayaaygar

SEQ ID NO: 2914 - DNA, 18 bp, Artificial Sequence
  Description of Artificial Sequence: Synthetic oligonucleotide
garaayaayaayaayaay

SEQ ID NO: 2915 - DNA, 18 bp, Artificial Sequence
  Description of Artificial Sequence: Synthetic oligonucleotide
aaygaraayaayaayaay

SEQ ID NO: 2916 - DNA, 18 bp, Artificial Sequence
  Description of Artificial Sequence: Synthetic oligonucleotide
aayaaygaraayaayaay

SEQ ID NO: 2917 - DNA, 18 bp, Artificial Sequence
  Description of Artificial Sequence: Synthetic oligonucleotide
aayaayaaygaraayaay

SEQ ID NO: 2918 - DNA, 18 bp, Artificial Sequence
  Description of Artificial Sequence: Synthetic oligonucleotide
aayaayaayaaygaraay

SEQ ID NO: 2919 - DNA, 18 bp, Artificial Sequence
  Description of Artificial Sequence: Synthetic oligonucleotide
aayaayaayaaygargar

SEQ ID NO: 2920 - DNA, 18 bp, Artificial Sequence
  Description of Artificial Sequence: Synthetic oligonucleotide
gargaraayaayaayaay

SEQ ID NO: 2921 - DNA, 18 bp, Artificial Sequence
  Description of Artificial Sequence: Synthetic oligonucleotide
garaaygaraayaayaay

SEQ ID NO: 2922 - DNA, 18 bp, Artificial Sequence
  Description of Artificial Sequence: Synthetic oligonucleotide
garaayaaygaraayaay

SEQ ID NO: 2923 - DNA, 18 bp, Artificial Sequence
  Description of Artificial Sequence: Synthetic oligonucleotide
garaayaayaaygaraay

SEQ ID NO: 2924 - DNA, 18 bp, Artificial Sequence
  Description of Artificial Sequence: Synthetic oligonucleotide
garaayaayaayaaygar

SEQ ID NO: 2925 - DNA, 18 bp, Artificial Sequence
  Description of Artificial Sequence: Synthetic oligonucleotide
aaygargaraayaayaay

SEQ ID NO: 2926 - DNA, 18 bp, Artificial Sequence
  Description of Artificial Sequence: Synthetic oligonucleotide
aaygaraaygaraayaay

SEQ ID NO: 2927 - DNA, 18 bp, Artificial Sequence
  Description of Artificial Sequence: Synthetic oligonucleotide
aaygaraayaaygaraay

SEQ ID NO: 2928 - DNA, 18 bp, Artificial Sequence
  Description of Artificial Sequence: Synthetic oligonucleotide
aaygaraayaayaaygar

SEQ ID NO: 2929 - DNA, 18 bp, Artificial Sequence
  Description of Artificial Sequence: Synthetic oligonucleotide
aayaaygargaraayaay

SEQ ID NO: 2930 - DNA, 18 bp, Artificial Sequence
  Description of Artificial Sequence: Synthetic oligonucleotide
aayaaygaraaygaraay

SEQ ID NO: 2931 - DNA, 18 bp, Artificial Sequence
  Description of Artificial Sequence: Synthetic oligonucleotide
aayaaygaraayaaygar

SEQ ID NO: 2932 - DNA, 18 bp, Artificial Sequence
  Description of Artificial Sequence: Synthetic oligonucleotide
aayaayaaygargaraay

SEQ ID NO: 2933 - DNA, 18 bp, Artificial Sequence
  Description of Artificial Sequence: Synthetic oligonucleotide
aayaayaaygaraaygar

SEQ ID NO: 2934 - DNA, 21 bp, Artificial Sequence
  Description of Artificial Sequence: Synthetic oligonucleotide
aayaayaayaaygargargar

SEQ ID NO: 2935 - DNA, 21 bp, Artificial Sequence
  Description of Artificial Sequence: Synthetic oligonucleotide
gargargaraayaayaayaay

SEQ ID NO: 2936 - DNA, 21 bp, Artificial Sequence
  Description of Artificial Sequence: Synthetic oligonucleotide
garaaygargaraayaayaay

SEQ ID NO: 2937 - DNA, 21 bp, Artificial Sequence
  Description of Artificial Sequence: Synthetic oligonucleotide
garaaygaraaygaraayaay

SEQ ID NO: 2938 - DNA, 21 bp, Artificial Sequence
  Description of Artificial Sequence: Synthetic oligonucleotide
garaaygaraayaaygaraay

SEQ ID NO: 2939 - DNA, 21 bp, Artificial Sequence
  Description of Artificial Sequence: Synthetic oligonucleotide
garaaygaraayaayaaygar

SEQ ID NO: 2940 - DNA, 21 bp, Artificial Sequence
  Description of Artificial Sequence: Synthetic oligonucleotide
garaayaaygargaraayaay

SEQ ID NO: 2941 - DNA, 21 bp, Artificial Sequence
  Description of Artificial Sequence: Synthetic oligonucleotide
garaayaaygaraaygaraay

SEQ ID NO: 2942 - DNA, 21 bp, Artificial Sequence
  Description of Artificial Sequence: Synthetic oligonucleotide
garaayaaygaraayaaygar

SEQ ID NO: 2943 - DNA, 21 bp, Artificial Sequence
  Description of Artificial Sequence: Synthetic oligonucleotide
garaayaayaaygaraaygar

SEQ ID NO: 2944 - DNA, 21 bp, Artificial Sequence
  Description of Artificial Sequence: Synthetic oligonucleotide
garaayaayaaygargaraay

SEQ ID NO: 2945 - DNA, 21 bp, Artificial Sequence
  Description of Artificial Sequence: Synthetic oligonucleotide
garaayaayaayaaygargar

SEQ ID NO: 2946 - DNA, 21 bp, Artificial Sequence
  Description of Artificial Sequence: Synthetic oligonucleotide
gargaraaygaraayaayaay

SEQ ID NO: 2947 - DNA, 21 bp, Artificial Sequence
  Description of Artificial Sequence: Synthetic oligonucleotide
gargaraayaaygaraayaay

SEQ ID NO: 2948 - DNA, 21 bp, Artificial Sequence
  Description of Artificial Sequence: Synthetic oligonucleotide
gargaraayaayaaygaraay

SEQ ID NO: 2949 - DNA, 21 bp, Artificial Sequence
  Description of Artificial Sequence: Synthetic oligonucleotide
gargaraayaayaayaaygar

SEQ ID NO: 2950 - DNA, 21 bp, Artificial Sequence
  Description of Artificial Sequence: Synthetic oligonucleotide
aaygargargaraayaayaay

SEQ ID NO: 2951 - DNA, 21 bp, Artificial Sequence
  Description of Artificial Sequence: Synthetic oligonucleotide
aaygargaraaygaraayaay

SEQ ID NO: 2952 - DNA, 21 bp, Artificial Sequence
  Description of Artificial Sequence: Synthetic oligonucleotide
aaygargaraayaaygaraay

SEQ ID NO: 2953 - DNA, 21 bp, Artificial Sequence
  Description of Artificial Sequence: Synthetic oligonucleotide
aaygargaraayaayaaygar

SEQ ID NO: 2954 - DNA, 21 bp, Artificial Sequence
  Description of Artificial Sequence: Synthetic oligonucleotide
aaygaraaygargaraayaay

SEQ ID NO: 2955 - DNA, 21 bp, Artificial Sequence
  Description of Artificial Sequence: Synthetic oligonucleotide
aaygaraayaaygargaraay

SEQ ID NO: 2956 - DNA, 21 bp, Artificial Sequence
  Description of Artificial Sequence: Synthetic oligonucleotide
aaygaraayaayaaygargar

SEQ ID NO: 2957 - DNA, 21 bp, Artificial Sequence
  Description of Artificial Sequence: Synthetic oligonucleotide
aaygaraaygaraaygaraay

SEQ ID NO: 2958 - DNA, 21 bp, Artificial Sequence
  Description of Artificial Sequence: Synthetic oligonucleotide
aaygaraaygaraayaaygar

SEQ ID NO: 2959 - DNA, 21 bp, Artificial Sequence
  Description of Artificial Sequence: Synthetic oligonucleotide
aaygaraayaaygaraaygar

SEQ ID NO: 2960 - DNA, 21 bp, Artificial Sequence
  Description of Artificial Sequence: Synthetic oligonucleotide
aayaaygargargaraayaay

SEQ ID NO: 2961 - DNA, 21 bp, Artificial Sequence
  Description of Artificial Sequence: Synthetic oligonucleotide
aayaaygargaraaygaraay

SEQ ID NO: 2962 - DNA, 21 bp, Artificial Sequence
  Description of Artificial Sequence: Synthetic oligonucleotide
aayaaygargaraayaaygar

SEQ ID NO: 2963 - DNA, 21 bp, Artificial Sequence
  Description of Artificial Sequence: Synthetic oligonucleotide
aayaaygaraaygargaraay

SEQ ID NO: 2964 - DNA, 21 bp, Artificial Sequence
  Description of Artificial Sequence: Synthetic oligonucleotide
aayaaygaraaygaraaygar

SEQ ID NO: 2965 - DNA, 21 bp, Artificial Sequence
  Description of Artificial Sequence: Synthetic oligonucleotide
aayaaygaraayaaygargar

SEQ ID NO: 2966 - DNA, 21 bp, Artificial Sequence
  Description of Artificial Sequence: Synthetic oligonucleotide
aayaayaaygargargaraay

SEQ ID NO: 2967 - DNA, 21 bp, Artificial Sequence
  Description of Artificial Sequence: Synthetic oligonucleotide
aayaayaaygargaraaygar

SEQ ID NO: 2968 - DNA, 21 bp, Artificial Sequence
  Description of Artificial Sequence: Synthetic oligonucleotide
aayaayaaygaraaygargar

SEQ ID NO: 2969 - DNA, 21 bp, Artificial Sequence
  Description of Artificial Sequence: Synthetic oligonucleotide
aayaayaayaayaaygargar

SEQ ID NO: 2970 - DNA, 21 bp, Artificial Sequence
  Description of Artificial Sequence: Synthetic oligonucleotide
gargaraayaayaayaayaay

SEQ ID NO: 2971 - DNA, 21 bp, Artificial Sequence
  Description of Artificial Sequence: Synthetic oligonucleotide
garaaygaraayaayaayaay

SEQ ID NO: 2972 - DNA, 21 bp, Artificial Sequence
  Description of Artificial Sequence: Synthetic oligonucleotide
garaayaaygaraayaayaay

SEQ ID NO: 2973 - DNA, 21 bp, Artificial Sequence
  Description of Artificial Sequence: Synthetic oligonucleotide
garaayaayaaygaraayaay

SEQ ID NO: 2974 - DNA, 21 bp, Artificial Sequence
  Description of Artificial Sequence: Synthetic oligonucleotide
garaayaayaayaaygaraay

SEQ ID NO: 2975 - DNA, 21 bp, Artificial Sequence
  Description of Artificial Sequence: Synthetic oligonucleotide
garaayaayaayaayaaygar

SEQ ID NO: 2976 - DNA, 21 bp, Artificial Sequence
  Description of Artificial Sequence: Synthetic oligonucleotide
aaygargaraayaayaayaay

SEQ ID NO: 2977 - DNA, 21 bp, Artificial Sequence
  Description of Artificial Sequence: Synthetic oligonucleotide
aaygaraaygaraayaayaay

SEQ ID NO: 2978 - DNA, 21 bp, Artificial Sequence
  Description of Artificial Sequence: Synthetic oligonucleotide
aaygaraayaaygaraayaay

SEQ ID NO: 2979 - DNA, 21 bp, Artificial Sequence
  Description of Artificial Sequence: Synthetic oligonucleotide
aaygaraayaayaaygaraay

SEQ ID NO: 2980 - DNA, 21 bp, Artificial Sequence
  Description of Artificial Sequence: Synthetic oligonucleotide
aaygaraayaayaayaaygar

SEQ ID NO: 2981 - DNA, 21 bp, Artificial Sequence
  Description of Artificial Sequence: Synthetic oligonucleotide
aayaaygargaraayaayaay

SEQ ID NO: 2982 - DNA, 21 bp, Artificial Sequence
  Description of Artificial Sequence: Synthetic oligonucleotide
aayaaygaraaygaraayaay

SEQ ID NO: 2983 - DNA, 21 bp, Artificial Sequence
  Description of Artificial Sequence: Synthetic oligonucleotide
aayaaygaraayaaygaraay

SEQ ID NO: 2984 - DNA, 21 bp, Artificial Sequence
  Description of Artificial Sequence: Synthetic oligonucleotide
aayaaygaraayaayaaygar

SEQ ID NO: 2985 - DNA, 21 bp, Artificial Sequence
  Description of Artificial Sequence: Synthetic oligonucleotide
aayaayaaygargaraayaay

SEQ ID NO: 2986 - DNA, 21 bp, Artificial Sequence
  Description of Artificial Sequence: Synthetic oligonucleotide
aayaayaaygaraaygaraay

SEQ ID NO: 2987 - DNA, 21 bp, Artificial Sequence
  Description of Artificial Sequence: Synthetic oligonucleotide
aayaayaaygaraayaaygar

SEQ ID NO: 2988 - DNA, 21 bp, Artificial Sequence
  Description of Artificial Sequence: Synthetic oligonucleotide
aayaayaayaaygargaraay

SEQ ID NO: 2989 - DNA, 21 bp, Artificial Sequence
  Description of Artificial Sequence: Synthetic oligonucleotide
aayaayaayaaygaraaygar

SEQ ID NO: 2990 - DNA, 21 bp, Artificial Sequence
  Description of Artificial Sequence: Synthetic oligonucleotide
aayaayaayaayaayaaygar

SEQ ID NO: 2991 - DNA, 21 bp, Artificial Sequence
  Description of Artificial Sequence: Synthetic oligonucleotide
garaayaayaayaayaayaay

SEQ ID NO: 2992 - DNA, 21 bp, Artificial Sequence
  Description of Artificial Sequence: Synthetic oligonucleotide
aaygaraayaayaayaayaay

SEQ ID NO: 2993 - DNA, 21 bp, Artificial Sequence
  Description of Artificial Sequence: Synthetic oligonucleotide
aayaaygaraayaayaayaay

SEQ ID NO: 2994 - DNA, 21 bp, Artificial Sequence
  Description of Artificial Sequence: Synthetic oligonucleotide
aayaayaaygaraayaayaay

SEQ ID NO: 2995 - DNA, 21 bp, Artificial Sequence
  Description of Artificial Sequence: Synthetic oligonucleotide
aayaayaayaaygaraayaay

SEQ ID NO: 2996 - DNA, 21 bp, Artificial Sequence
  Description of Artificial Sequence: Synthetic oligonucleotide
aayaayaayaayaaygaraay

SEQ ID NO: 2997 - DNA, 12 bp, Artificial Sequence
  Description of Artificial Sequence: Synthetic oligonucleotide
aayaayaaycay

SEQ ID NO: 2998 - DNA, 12 bp, Artificial Sequence
  Description of Artificial Sequence: Synthetic oligonucleotide
cayaayaayaay

SEQ ID NO: 2999 - DNA, 12 bp, Artificial Sequence
  Description of Artificial Sequence: Synthetic oligonucleotide
aaycayaayaay

SEQ ID NO: 3000 - DNA, 12 bp, Artificial Sequence
  Description of Artificial Sequence: Synthetic oligonucleotide
aayaaycayaay

SEQ ID NO: 3001 - DNA, 15 bp, Artificial Sequence
  Description of Artificial Sequence: Synthetic oligonucleotide
aayaayaayaaycay

SEQ ID NO: 3002 - DNA, 15 bp, Artificial Sequence
  Description of Artificial Sequence: Synthetic oligonucleotide
cayaayaayaayaay

SEQ ID NO: 3003 - DNA, 15 bp, Artificial Sequence
  Description of Artificial Sequence: Synthetic oligonucleotide
aaycayaayaayaay

SEQ ID NO: 3004 - DNA, 15 bp, Artificial Sequence
  Description of Artificial Sequence: Synthetic oligonucleotide
aayaaycayaayaay

SEQ ID NO: 3005 - DNA, 15 bp, Artificial Sequence
  Description of Artificial Sequence: Synthetic oligonucleotide
aayaayaaycayaay

SEQ ID NO: 3006 - DNA, 15 bp, Artificial Sequence
  Description of Artificial Sequence: Synthetic oligonucleotide
aayaayaaycaycay

SEQ ID NO: 3007 - DNA, 15 bp, Artificial Sequence
  Description of Artificial Sequence: Synthetic oligonucleotide
caycayaayaayaay

SEQ ID NO: 3008 - DNA, 15 bp, Artificial Sequence
  Description of Artificial Sequence: Synthetic oligonucleotide
cayaaycayaayaay

SEQ ID NO: 3009 - DNA, 15 bp, Artificial Sequence
  Description of Artificial Sequence: Synthetic oligonucleotide
cayaayaaycayaay

SEQ ID NO: 3010 - DNA, 15 bp, Artificial Sequence
  Description of Artificial Sequence: Synthetic oligonucleotide
cayaayaayaaycay

SEQ ID NO: 3011 - DNA, 15 bp, Artificial Sequence
  Description of Artificial Sequence: Synthetic oligonucleotide
aaycaycayaayaay

SEQ ID NO: 3012 - DNA, 15 bp, Artificial Sequence
  Description of Artificial Sequence: Synthetic oligonucleotide
aaycayaaycayaay

SEQ ID NO: 3013 - DNA, 15 bp, Artificial Sequence
  Description of Artificial Sequence: Synthetic oligonucleotide
aaycayaayaaycay

SEQ ID NO: 3014 - DNA, 15 bp, Artificial Sequence
  Description of Artificial Sequence: Synthetic oligonucleotide
aayaaycaycayaay

SEQ ID NO: 3015 - DNA, 15 bp, Artificial Sequence
  Description of Artificial Sequence: Synthetic oligonucleotide
aayaaycayaaycay

SEQ ID NO: 3016 - DNA, 18 bp, Artificial Sequence
  Description of Artificial Sequence: Synthetic oligonucleotide
aayaayaayaayaaycay

SEQ ID NO: 3017 - DNA, 18 bp, Artificial Sequence
  Description of Artificial Sequence: Synthetic oligonucleotide
cayaayaayaayaayaay

SEQ ID NO: 3018 - DNA, 18 bp, Artificial Sequence
  Description of Artificial Sequence: Synthetic oligonucleotide
aaycayaayaayaayaay

SEQ ID NO: 3019 - DNA, 18 bp, Artificial Sequence
  Description of Artificial Sequence: Synthetic oligonucleotide
aayaaycayaayaayaay

SEQ ID NO: 3020 - DNA, 18 bp, Artificial Sequence
  Description of Artificial Sequence: Synthetic oligonucleotide
aayaayaaycayaayaay

SEQ ID NO: 3021 - DNA, 18 bp, Artificial Sequence
  Description of Artificial Sequence: Synthetic oligonucleotide
aayaayaayaaycayaay

SEQ ID NO: 3022 - DNA, 18 bp, Artificial Sequence
  Description of Artificial Sequence: Synthetic oligonucleotide
aayaayaayaaycaycay

SEQ ID NO: 3023 - DNA, 18 bp, Artificial Sequence
  Description of Artificial Sequence: Synthetic oligonucleotide
caycayaayaayaayaay

SEQ ID NO: 3024 - DNA, 18 bp, Artificial Sequence
  Description of Artificial Sequence: Synthetic oligonucleotide
cayaaycayaayaayaay

SEQ ID NO: 3025 - DNA, 18 bp, Artificial Sequence
  Description of Artificial Sequence: Synthetic oligonucleotide
cayaayaaycayaayaay

SEQ ID NO: 3026 - DNA, 18 bp, Artificial Sequence
  Description of Artificial Sequence: Synthetic oligonucleotide
cayaayaayaaycayaay

SEQ ID NO: 3027 - DNA, 18 bp, Artificial Sequence
  Description of Artificial Sequence: Synthetic oligonucleotide
cayaayaayaayaaycay

SEQ ID NO: 3028 - DNA, 18 bp, Artificial Sequence
  Description of Artificial Sequence: Synthetic oligonucleotide
aaycaycayaayaayaay

SEQ ID NO: 3029 - DNA, 18 bp, Artificial Sequence
  Description of Artificial Sequence: Synthetic oligonucleotide
aaycayaaycayaayaay

SEQ ID NO: 3030 - DNA, 18 bp, Artificial Sequence
  Description of Artificial Sequence: Synthetic oligonucleotide
aaycayaayaaycayaay

SEQ ID NO: 3031 - DNA, 18 bp, Artificial Sequence
  Description of Artificial Sequence: Synthetic oligonucleotide
aaycayaayaayaaycay

SEQ ID NO: 3032 - DNA, 18 bp, Artificial Sequence
  Description of Artificial Sequence: Synthetic oligonucleotide
aayaaycaycayaayaay

SEQ ID NO: 3033 - DNA, 18 bp, Artificial Sequence
  Description of Artificial Sequence: Synthetic oligonucleotide
aayaaycayaaycayaay

SEQ ID NO: 3034 - DNA, 18 bp, Artificial Sequence
  Description of Artificial Sequence: Synthetic oligonucleotide
aayaaycayaayaaycay

SEQ ID NO: 3035 - DNA, 18 bp, Artificial Sequence
  Description of Artificial Sequence: Synthetic oligonucleotide
aayaayaaycaycayaay

SEQ ID NO: 3036 - DNA, 18 bp, Artificial Sequence
  Description of Artificial Sequence: Synthetic oligonucleotide
aayaayaaycayaaycay

SEQ ID NO: 3037 - DNA, 21 bp, Artificial Sequence
  Description of Artificial Sequence: Synthetic oligonucleotide
aayaayaayaaycaycaycay

SEQ ID NO: 3038 - DNA, 21 bp, Artificial Sequence
  Description of Artificial Sequence: Synthetic oligonucleotide
caycaycayaayaayaayaay

SEQ ID NO: 3039 - DNA, 21 bp, Artificial Sequence
  Description of Artificial Sequence: Synthetic oligonucleotide
cayaaycaycayaayaayaay

SEQ ID NO: 3040 - DNA, 21 bp, Artificial Sequence
  Description of Artificial Sequence: Synthetic oligonucleotide
cayaaycayaaycayaayaay

SEQ ID NO: 3041 - DNA, 21 bp, Artificial Sequence
  Description of Artificial Sequence: Synthetic oligonucleotide
cayaaycayaayaaycayaay

SEQ ID NO: 3042 - DNA, 21 bp, Artificial Sequence
  Description of Artificial Sequence: Synthetic oligonucleotide
cayaaycayaayaayaaycay

SEQ ID NO: 3043 - DNA, 21 bp, Artificial Sequence
  Description of Artificial Sequence: Synthetic oligonucleotide
cayaayaaycaycayaayaay

SEQ ID NO: 3044 - DNA, 21 bp, Artificial Sequence
  Description of Artificial Sequence: Synthetic oligonucleotide
cayaayaaycayaaycayaay

SEQ ID NO: 3045 - DNA, 21 bp, Artificial Sequence
  Description of Artificial Sequence: Synthetic oligonucleotide
cayaayaaycayaayaaycay

SEQ ID NO: 3046 - DNA, 21 bp, Artificial Sequence
  Description of Artificial Sequence: Synthetic oligonucleotide
cayaayaayaaycayaaycay

SEQ ID NO: 3047 - DNA, 21 bp, Artificial Sequence
  Description of Artificial Sequence: Synthetic oligonucleotide
cayaayaayaaycaycayaay

SEQ ID NO: 3048 - DNA, 21 bp, Artificial Sequence
  Description of Artificial Sequence: Synthetic oligonucleotide
cayaayaayaayaaycaycay

SEQ ID NO: 3049 - DNA, 21 bp, Artificial Sequence
  Description of Artificial Sequence: Synthetic oligonucleotide
caycayaaycayaayaayaay

SEQ ID NO: 3050 - DNA, 21 bp, Artificial Sequence
  Description of Artificial Sequence: Synthetic oligonucleotide
caycayaayaaycayaayaay

SEQ ID NO: 3051 - DNA, 21 bp, Artificial Sequence
  Description of Artificial Sequence: Synthetic oligonucleotide
caycayaayaayaaycayaay

SEQ ID NO: 3052 - DNA, 21 bp, Artificial Sequence
  Description of Artificial Sequence: Synthetic oligonucleotide
caycayaayaayaayaaycay

SEQ ID NO: 3053 - DNA, 21 bp, Artificial Sequence
  Description of Artificial Sequence: Synthetic oligonucleotide
aaycaycaycayaayaayaay

SEQ ID NO: 3054 - DNA, 21 bp, Artificial Sequence
  Description of Artificial Sequence: Synthetic oligonucleotide
aaycaycayaaycayaayaay

SEQ ID NO: 3055 - DNA, 21 bp, Artificial Sequence
  Description of Artificial Sequence: Synthetic oligonucleotide
aaycaycayaayaaycayaay

SEQ ID NO: 3056 - DNA, 21 bp, Artificial Sequence
  Description of Artificial Sequence: Synthetic oligonucleotide
aaycaycayaayaayaaycay

SEQ ID NO: 3057 - DNA, 21 bp, Artificial Sequence
  Description of Artificial Sequence: Synthetic oligonucleotide
aaycayaaycaycayaayaay

SEQ ID NO: 3058 - DNA, 21 bp, Artificial Sequence
  Description of Artificial Sequence: Synthetic oligonucleotide
aaycayaayaaycaycayaay

SEQ ID NO: 3059 - DNA, 21 bp, Artificial Sequence
  Description of Artificial Sequence: Synthetic oligonucleotide
aaycayaayaayaaycaycay

SEQ ID NO: 3060 - DNA, 21 bp, Artificial Sequence
  Description of Artificial Sequence: Synthetic oligonucleotide
aaycayaaycayaaycayaay

SEQ ID NO: 3061 - DNA, 21 bp, Artificial Sequence
  Description of Artificial Sequence: Synthetic oligonucleotide
aaycayaaycayaayaaycay

SEQ ID NO: 3062 - DNA, 21 bp, Artificial Sequence
  Description of Artificial Sequence: Synthetic oligonucleotide
aaycayaayaaycayaaycay

SEQ ID NO: 3063 - DNA, 21 bp, Artificial Sequence
  Description of Artificial Sequence: Synthetic oligonucleotide
aayaaycaycaycayaayaay

SEQ ID NO: 3064 - DNA, 21 bp, Artificial Sequence
  Description of Artificial Sequence: Synthetic oligonucleotide
aayaaycaycayaaycayaay

SEQ ID NO: 3065 - DNA, 21 bp, Artificial Sequence
  Description of Artificial Sequence: Synthetic oligonucleotide
aayaaycaycayaayaaycay

SEQ ID NO: 3066 - DNA, 21 bp, Artificial Sequence
  Description of Artificial Sequence: Synthetic oligonucleotide
aayaaycayaaycaycayaay

SEQ ID NO: 3067 - DNA, 21 bp, Artificial Sequence
  Description of Artificial Sequence: Synthetic oligonucleotide
aayaaycayaaycayaaycay

SEQ ID NO: 3068 - DNA, 21 bp, Artificial Sequence
  Description of Artificial Sequence: Synthetic oligonucleotide
aayaaycayaayaaycaycay

SEQ ID NO: 3069 - DNA, 21 bp, Artificial Sequence
  Description of Artificial Sequence: Synthetic oligonucleotide
aayaayaaycaycaycayaay

SEQ ID NO: 3070 - DNA, 21 bp, Artificial Sequence
  Description of Artificial Sequence: Synthetic oligonucleotide
aayaayaaycaycayaaycay

SEQ ID NO: 3071 - DNA, 21 bp, Artificial Sequence
  Description of Artificial Sequence: Synthetic oligonucleotide
aayaayaaycayaaycaycay

SEQ ID NO: 3072 - DNA, 21 bp, Artificial Sequence
  Description of Artificial Sequence: Synthetic oligonucleotide
aayaayaayaayaaycaycay

SEQ ID NO: 3073 - DNA, 21 bp, Artificial Sequence
  Description of Artificial Sequence: Synthetic oligonucleotide
caycayaayaayaayaayaay

SEQ ID NO: 3074 - DNA, 21 bp, Artificial Sequence
  Description of Artificial Sequence: Synthetic oligonucleotide
cayaaycayaayaayaayaay

SEQ ID NO: 3075 - DNA, 21 bp, Artificial Sequence
  Description of Artificial Sequence: Synthetic oligonucleotide
cayaayaaycayaayaayaay

SEQ ID NO: 3076 - DNA, 21 bp, Artificial Sequence
  Description of Artificial Sequence: Synthetic oligonucleotide
cayaayaayaaycayaayaay

SEQ ID NO: 3077 - DNA, 21 bp, Artificial Sequence
  Description of Artificial Sequence: Synthetic oligonucleotide
cayaayaayaayaaycayaay

SEQ ID NO: 3078 - DNA, 21 bp, Artificial Sequence
  Description of Artificial Sequence: Synthetic oligonucleotide
cayaayaayaayaayaaycay

SEQ ID NO: 3079 - DNA, 21 bp, Artificial Sequence
  Description of Artificial Sequence: Synthetic oligonucleotide
aaycaycayaayaayaayaay

SEQ ID NO: 3080 - DNA, 21 bp, Artificial Sequence
  Description of Artificial Sequence: Synthetic oligonucleotide
aaycayaaycayaayaayaay

SEQ ID NO: 3081 - DNA, 21 bp, Artificial Sequence
  Description of Artificial Sequence: Synthetic oligonucleotide
aaycayaayaaycayaayaay

SEQ ID NO: 3082 - DNA, 21 bp, Artificial Sequence
  Description of Artificial Sequence: Synthetic oligonucleotide
aaycayaayaayaaycayaay

SEQ ID NO: 3083 - DNA, 21 bp, Artificial Sequence
  Description of Artificial Sequence: Synthetic oligonucleotide
aaycayaayaayaayaaycay

SEQ ID NO: 3084 - DNA, 21 bp, Artificial Sequence
  Description of Artificial Sequence: Synthetic oligonucleotide
aayaaycaycayaayaayaay

SEQ ID NO: 3085 - DNA, 21 bp, Artificial Sequence
  Description of Artificial Sequence: Synthetic oligonucleotide
aayaaycayaaycayaayaay

SEQ ID NO: 3086 - DNA, 21 bp, Artificial Sequence
  Description of Artificial Sequence: Synthetic oligonucleotide
aayaaycayaayaaycayaay

SEQ ID NO: 3087 - DNA, 21 bp, Artificial Sequence
  Description of Artificial Sequence: Synthetic oligonucleotide
aayaaycayaayaayaaycay

SEQ ID NO: 3088 - DNA, 21 bp, Artificial Sequence
  Description of Artificial Sequence: Synthetic oligonucleotide
aayaayaaycaycayaayaay

SEQ ID NO: 3089 - DNA, 21 bp, Artificial Sequence
  Description of Artificial Sequence: Synthetic oligonucleotide
aayaayaaycayaaycayaay

SEQ ID NO: 3090 - DNA, 21 bp, Artificial Sequence
  Description of Artificial Sequence: Synthetic oligonucleotide
aayaayaaycayaayaaycay

SEQ ID NO: 3091 - DNA, 21 bp, Artificial Sequence
  Description of Artificial Sequence: Synthetic oligonucleotide
aayaayaayaaycaycayaay

SEQ ID NO: 3092 - DNA, 21 bp, Artificial Sequence
  Description of Artificial Sequence: Synthetic oligonucleotide
aayaayaayaaycayaaycay

SEQ ID NO: 3093 - DNA, 21 bp, Artificial Sequence
  Description of Artificial Sequence: Synthetic oligonucleotide
aayaayaayaayaayaaycay

SEQ ID NO: 3094 - DNA, 21 bp, Artificial Sequence
  Description of Artificial Sequence: Synthetic oligonucleotide
cayaayaayaayaayaayaay

SEQ ID NO: 3095 - DNA, 21 bp, Artificial Sequence
  Description of Artificial Sequence: Synthetic oligonucleotide
aaycayaayaayaayaayaay

SEQ ID NO: 3096 - DNA, 21 bp, Artificial Sequence
  Description of Artificial Sequence: Synthetic oligonucleotide
aayaaycayaayaayaayaay

SEQ ID NO: 3097 - DNA, 21 bp, Artificial Sequence
  Description of Artificial Sequence: Synthetic oligonucleotide
aayaayaaycayaayaayaay

SEQ ID NO: 3098 - DNA, 21 bp, Artificial Sequence
  Description of Artificial Sequence: Synthetic oligonucleotide
aayaayaayaaycayaayaay

SEQ ID NO: 3099 - DNA, 21 bp, Artificial Sequence
  Description of Artificial Sequence: Synthetic oligonucleotide
aayaayaayaayaaycayaay

SEQ ID NO: 3100 - DNA, 12 bp, Artificial Sequence
  Description of Artificial Sequence: Synthetic oligonucleotide
aayaayaaygay

SEQ ID NO: 3101 - DNA, 12 bp, Artificial Sequence
  Description of Artificial Sequence: Synthetic oligonucleotide
gayaayaayaay

SEQ ID NO: 3102 - DNA, 12 bp, Artificial Sequence
  Description of Artificial Sequence: Synthetic oligonucleotide
aaygayaayaay

SEQ ID NO: 3103 - DNA, 12 bp, Artificial Sequence
  Description of Artificial Sequence: Synthetic oligonucleotide
aayaaygayaay

SEQ ID NO: 3104 - DNA, 15 bp, Artificial Sequence
  Description of Artificial Sequence: Synthetic oligonucleotide
aayaayaayaaygay

SEQ ID NO: 3105 - DNA, 15 bp, Artificial Sequence
  Description of Artificial Sequence: Synthetic oligonucleotide
gayaayaayaayaay

SEQ ID NO: 3106 - DNA, 15 bp, Artificial Sequence
  Description of Artificial Sequence: Synthetic oligonucleotide
aaygayaayaayaay

SEQ ID NO: 3107 - DNA, 15 bp, Artificial Sequence
  Description of Artificial Sequence: Synthetic oligonucleotide
aayaaygayaayaay

SEQ ID NO: 3108 - DNA, 15 bp, Artificial Sequence
  Description of Artificial Sequence: Synthetic oligonucleotide
aayaayaaygayaay

SEQ ID NO: 3109 - DNA, 15 bp, Artificial Sequence
  Description of Artificial Sequence: Synthetic oligonucleotide
aayaayaaygaygay

SEQ ID NO: 3110 - DNA, 15 bp, Artificial Sequence
  Description of Artificial Sequence: Synthetic oligonucleotide
gaygayaayaayaay

SEQ ID NO: 3111 - DNA, 15 bp, Artificial Sequence
  Description of Artificial Sequence: Synthetic oligonucleotide
gayaaygayaayaay

SEQ ID NO: 3112 - DNA, 15 bp, Artificial Sequence
  Description of Artificial Sequence: Synthetic oligonucleotide
gayaayaaygayaay

SEQ ID NO: 3113 - DNA, 15 bp, Artificial Sequence
  Description of Artificial Sequence: Synthetic oligonucleotide
gayaayaayaaygay

SEQ ID NO: 3114 - DNA, 15 bp, Artificial Sequence
  Description of Artificial Sequence: Synthetic oligonucleotide
aaygaygayaayaay

SEQ ID NO: 3115 - DNA, 15 bp, Artificial Sequence
  Description of Artificial Sequence: Synthetic oligonucleotide
aaygayaaygayaay

SEQ ID NO: 3116 - DNA, 15 bp, Artificial Sequence
  Description of Artificial Sequence: Synthetic oligonucleotide
aaygayaayaaygay

SEQ ID NO: 3117 - DNA, 15 bp, Artificial Sequence
  Description of Artificial Sequence: Synthetic oligonucleotide
aayaaygaygayaay

SEQ ID NO: 3118 - DNA, 15 bp, Artificial Sequence
  Description of Artificial Sequence: Synthetic oligonucleotide
aayaaygayaaygay

SEQ ID NO: 3119 - DNA, 18 bp, Artificial Sequence
  Description of Artificial Sequence: Synthetic oligonucleotide
aayaayaayaayaaygay

SEQ ID NO: 3120 - DNA, 18 bp, Artificial Sequence
  Description of Artificial Sequence: Synthetic oligonucleotide
gayaayaayaayaayaay

SEQ ID NO: 3121 - DNA, 18 bp, Artificial Sequence
  Description of Artificial Sequence: Synthetic oligonucleotide
aaygayaayaayaayaay

SEQ ID NO: 3122 - DNA, 18 bp, Artificial Sequence
  Description of Artificial Sequence: Synthetic oligonucleotide
aayaaygayaayaayaay

SEQ ID NO: 3123 - DNA, 18 bp, Artificial Sequence
  Description of Artificial Sequence: Synthetic oligonucleotide
aayaayaaygayaayaay

SEQ ID NO: 3124 - DNA, 18 bp, Artificial Sequence
  Description of Artificial Sequence: Synthetic oligonucleotide
aayaayaayaaygayaay

SEQ ID NO: 3125 - DNA, 18 bp, Artificial Sequence
  Description of Artificial Sequence: Synthetic oligonucleotide
aayaayaayaaygaygay

SEQ ID NO: 3126 - DNA, 18 bp, Artificial Sequence
  Description of Artificial Sequence: Synthetic oligonucleotide
gaygayaayaayaayaay

SEQ ID NO: 3127 - DNA, 18 bp, Artificial Sequence
  Description of Artificial Sequence: Synthetic oligonucleotide
gayaaygayaayaayaay

SEQ ID NO: 3128 - DNA, 18 bp, Artificial Sequence
  Description of Artificial Sequence: Synthetic oligonucleotide
gayaayaaygayaayaay

SEQ ID NO: 3129 - DNA, 18 bp, Artificial Sequence
  Description of Artificial Sequence: Synthetic oligonucleotide
gayaayaayaaygayaay

SEQ ID NO: 3130 - DNA, 18 bp, Artificial Sequence
  Description of Artificial Sequence: Synthetic oligonucleotide
gayaayaayaayaaygay

SEQ ID NO: 3131 - DNA, 18 bp, Artificial Sequence
  Description of Artificial Sequence: Synthetic oligonucleotide
aaygaygayaayaayaay

SEQ ID NO: 3132 - DNA, 18 bp, Artificial Sequence
  Description of Artificial Sequence: Synthetic oligonucleotide
aaygayaaygayaayaay

SEQ ID NO: 3133 - DNA, 18 bp, Artificial Sequence
  Description of Artificial Sequence: Synthetic oligonucleotide
aaygayaayaaygayaay

SEQ ID NO: 3134 - DNA, 18 bp, Artificial Sequence
  Description of Artificial Sequence: Synthetic oligonucleotide
aaygayaayaayaaygay

SEQ ID NO: 3135 - DNA, 18 bp, Artificial Sequence
  Description of Artificial Sequence: Synthetic oligonucleotide
aayaaygaygayaayaay

SEQ ID NO: 3136 - DNA, 18 bp, Artificial Sequence
  Description of Artificial Sequence: Synthetic oligonucleotide
aayaaygayaaygayaay

SEQ ID NO: 3137 - DNA, 18 bp, Artificial Sequence
  Description of Artificial Sequence: Synthetic oligonucleotide
aayaaygayaayaaygay

SEQ ID NO: 3138 - DNA, 18 bp, Artificial Sequence
  Description of Artificial Sequence: Synthetic oligonucleotide
aayaayaaygaygayaay

SEQ ID NO: 3139 - DNA, 18 bp, Artificial Sequence
  Description of Artificial Sequence: Synthetic oligonucleotide
aayaayaaygayaaygay

SEQ ID NO: 3140 - DNA, 21 bp, Artificial Sequence
  Description of Artificial Sequence: Synthetic oligonucleotide
aayaayaayaaygaygaygay

SEQ ID NO: 3141 - DNA, 21 bp, Artificial Sequence
  Description of Artificial Sequence: Synthetic oligonucleotide
gaygaygayaayaayaayaay

SEQ ID NO: 3142 - DNA, 21 bp, Artificial Sequence
  Description of Artificial Sequence: Synthetic oligonucleotide
gayaaygaygayaayaayaay

SEQ ID NO: 3143 - DNA, 21 bp, Artificial Sequence
  Description of Artificial Sequence: Synthetic oligonucleotide
gayaaygayaaygayaayaay

SEQ ID NO: 3144 - DNA, 21 bp, Artificial Sequence
  Description of Artificial Sequence: Synthetic oligonucleotide
gayaaygayaayaaygayaay

SEQ ID NO: 3145 - DNA, 21 bp, Artificial Sequence
  Description of Artificial Sequence: Synthetic oligonucleotide
gayaaygayaayaayaaygay

SEQ ID NO: 3146 - DNA, 21 bp, Artificial Sequence
  Description of Artificial Sequence: Synthetic oligonucleotide
gayaayaaygaygayaayaay

SEQ ID NO: 3147 - DNA, 21 bp, Artificial Sequence
  Description of Artificial Sequence: Synthetic oligonucleotide
gayaayaaygayaaygayaay

SEQ ID NO: 3148 - DNA, 21 bp, Artificial Sequence
  Description of Artificial Sequence: Synthetic oligonucleotide
gayaayaaygayaayaaygay

SEQ ID NO: 3149 - DNA, 21 bp, Artificial Sequence
  Description of Artificial Sequence: Synthetic oligonucleotide
gayaayaayaaygayaaygay

SEQ ID NO: 3150 - DNA, 21 bp, Artificial Sequence
  Description of Artificial Sequence: Synthetic oligonucleotide
gayaayaayaaygaygayaay

SEQ ID NO: 3151 - DNA, 21 bp, Artificial Sequence
  Description of Artificial Sequence: Synthetic oligonucleotide
gayaayaayaayaaygaygay

SEQ ID NO: 3152 - DNA, 21 bp, Artificial Sequence
  Description of Artificial Sequence: Synthetic oligonucleotide
gaygayaaygayaayaayaay

SEQ ID NO: 3153 - DNA, 21 bp, Artificial Sequence
  Description of Artificial Sequence: Synthetic oligonucleotide
gaygayaayaaygayaayaay

SEQ ID NO: 3154 - DNA, 21 bp, Artificial Sequence
  Description of Artificial Sequence: Synthetic oligonucleotide
gaygayaayaayaaygayaay

SEQ ID NO: 3155 - DNA, 21 bp, Artificial Sequence
  Description of Artificial Sequence: Synthetic oligonucleotide
gaygayaayaayaayaaygay

SEQ ID NO: 3156 - DNA, 21 bp, Artificial Sequence
  Description of Artificial Sequence: Synthetic oligonucleotide
aaygaygaygayaayaayaay

SEQ ID NO: 3157 - DNA, 21 bp, Artificial Sequence
  Description of Artificial Sequence: Synthetic oligonucleotide
aaygaygayaaygayaayaay

SEQ ID NO: 3158 - DNA, 21 bp, Artificial Sequence
  Description of Artificial Sequence: Synthetic oligonucleotide
aaygaygayaayaaygayaay

SEQ ID NO: 3159 - DNA, 21 bp, Artificial Sequence
  Description of Artificial Sequence: Synthetic oligonucleotide
aaygaygayaayaayaaygay

SEQ ID NO: 3160 - DNA, 21 bp, Artificial Sequence
  Description of Artificial Sequence: Synthetic oligonucleotide
aaygayaaygaygayaayaay

SEQ ID NO: 3161 - DNA, 21 bp, Artificial Sequence
  Description of Artificial Sequence: Synthetic oligonucleotide
aaygayaayaaygaygayaay

SEQ ID NO: 3162 - DNA, 21 bp, Artificial Sequence
  Description of Artificial Sequence: Synthetic oligonucleotide
aaygayaayaayaaygaygay

SEQ ID NO: 3163 - DNA, 21 bp, Artificial Sequence
  Description of Artificial Sequence: Synthetic oligonucleotide
aaygayaaygayaaygayaay

SEQ ID NO: 3164 - DNA, 21 bp, Artificial Sequence
  Description of Artificial Sequence: Synthetic oligonucleotide
aaygayaaygayaayaaygay

SEQ ID NO: 3165 - DNA, 21 bp, Artificial Sequence
  Description of Artificial Sequence: Synthetic oligonucleotide
aaygayaayaaygayaaygay

SEQ ID NO: 3166 - DNA, 21 bp, Artificial Sequence
  Description of Artificial Sequence: Synthetic oligonucleotide
aayaaygaygaygayaayaay

SEQ ID NO: 3167 - DNA, 21 bp, Artificial Sequence
  Description of Artificial Sequence: Synthetic oligonucleotide
aayaaygaygayaaygayaay

SEQ ID NO: 3168 - DNA, 21 bp, Artificial Sequence
  Description of Artificial Sequence: Synthetic oligonucleotide
aayaaygaygayaayaaygay

SEQ ID NO: 3169 - DNA, 21 bp, Artificial Sequence
  Description of Artificial Sequence: Synthetic oligonucleotide
aayaaygayaaygaygayaay

SEQ ID NO: 3170 - DNA, 21 bp, Artificial Sequence
  Description of Artificial Sequence: Synthetic oligonucleotide
aayaaygayaaygayaaygay

SEQ ID NO: 3171 - DNA, 21 bp, Artificial Sequence
  Description of Artificial Sequence: Synthetic oligonucleotide
aayaaygayaayaaygaygay

SEQ ID NO: 3172 - DNA, 21 bp, Artificial Sequence
  Description of Artificial Sequence: Synthetic oligonucleotide
aayaayaaygaygaygayaay

SEQ ID NO: 3173 - DNA, 21 bp, Artificial Sequence
  Description of Artificial Sequence: Synthetic oligonucleotide
aayaayaaygaygayaaygay

SEQ ID NO: 3174 - DNA, 21 bp, Artificial Sequence
  Description of Artificial Sequence: Synthetic oligonucleotide
aayaayaaygayaaygaygay

SEQ ID NO: 3175 - DNA, 21 bp, Artificial Sequence
  Description of Artificial Sequence: Synthetic oligonucleotide
aayaayaayaayaaygaygay

SEQ ID NO: 3176 - DNA, 21 bp, Artificial Sequence
  Description of Artificial Sequence: Synthetic oligonucleotide
gaygayaayaayaayaayaay

SEQ ID NO: 3177 - DNA, 21 bp, Artificial Sequence
  Description of Artificial Sequence: Synthetic oligonucleotide
gayaaygayaayaayaayaay

SEQ ID NO: 3178 - DNA, 21 bp, Artificial Sequence
  Description of Artificial Sequence: Synthetic oligonucleotide
gayaayaaygayaayaayaay

SEQ ID NO: 3179 - DNA, 21 bp, Artificial Sequence
  Description of Artificial Sequence: Synthetic oligonucleotide
gayaayaayaaygayaayaay

SEQ ID NO: 3180 - DNA, 21 bp, Artificial Sequence
  Description of Artificial Sequence: Synthetic oligonucleotide
gayaayaayaayaaygayaay

SEQ ID NO: 3181 - DNA, 21 bp, Artificial Sequence
  Description of Artificial Sequence: Synthetic oligonucleotide
gayaayaayaayaayaaygay

SEQ ID NO: 3182 - DNA, 21 bp, Artificial Sequence
  Description of Artificial Sequence: Synthetic oligonucleotide
aaygaygayaayaayaayaay

SEQ ID NO: 3183 - DNA, 21 bp, Artificial Sequence
  Description of Artificial Sequence: Synthetic oligonucleotide
aaygayaaygayaayaayaay

SEQ ID NO: 3184 - DNA, 21 bp, Artificial Sequence
  Description of Artificial Sequence: Synthetic oligonucleotide
aaygayaayaaygayaayaay

SEQ ID NO: 3185 - DNA, 21 bp, Artificial Sequence
  Description of Artificial Sequence: Synthetic oligonucleotide
aaygayaayaayaaygayaay

SEQ ID NO: 3186 - DNA, 21 bp, Artificial Sequence
  Description of Artificial Sequence: Synthetic oligonucleotide
aaygayaayaayaayaaygay

SEQ ID NO: 3187 - DNA, 21 bp, Artificial Sequence
  Description of Artificial Sequence: Synthetic oligonucleotide
aayaaygaygayaayaayaay

SEQ ID NO: 3188 - DNA, 21 bp, Artificial Sequence
  Description of Artificial Sequence: Synthetic oligonucleotide
aayaaygayaaygayaayaay

SEQ ID NO: 3189 - DNA, 21 bp, Artificial Sequence
  Description of Artificial Sequence: Synthetic oligonucleotide
aayaaygayaayaaygayaay

SEQ ID NO: 3190 - DNA, 21 bp, Artificial Sequence
  Description of Artificial Sequence: Synthetic oligonucleotide
aayaaygayaayaayaaygay

SEQ ID NO: 3191 - DNA, 21 bp, Artificial Sequence
  Description of Artificial Sequence: Synthetic oligonucleotide
aayaayaaygaygayaayaay

SEQ ID NO: 3192 - DNA, 21 bp, Artificial Sequence
  Description of Artificial Sequence: Synthetic oligonucleotide
aayaayaaygayaaygayaay

SEQ ID NO: 3193 - DNA, 21 bp, Artificial Sequence
  Description of Artificial Sequence: Synthetic oligonucleotide
aayaayaaygayaayaaygay

SEQ ID NO: 3194 - DNA, 21 bp, Artificial Sequence
  Description of Artificial Sequence: Synthetic oligonucleotide
aayaayaayaaygaygayaay

SEQ ID NO: 3195 - DNA, 21 bp, Artificial Sequence
  Description of Artificial Sequence: Synthetic oligonucleotide
aayaayaayaaygayaaygay

SEQ ID NO: 3196 - DNA, 21 bp, Artificial Sequence
  Description of Artificial Sequence: Synthetic oligonucleotide
aayaayaayaayaayaaygay

SEQ ID NO: 3197 - DNA, 21 bp, Artificial Sequence
  Description of Artificial Sequence: Synthetic oligonucleotide
gayaayaayaayaayaayaay

SEQ ID NO: 3198 - DNA, 21 bp, Artificial Sequence
  Description of Artificial Sequence: Synthetic oligonucleotide
aaygayaayaayaayaayaay

SEQ ID NO: 3199 - DNA, 21 bp, Artificial Sequence
  Description of Artificial Sequence: Synthetic oligonucleotide
aayaaygayaayaayaayaay

SEQ ID NO: 3200 - DNA, 21 bp, Artificial Sequence
  Description of Artificial Sequence: Synthetic oligonucleotide
aayaayaaygayaayaayaay

SEQ ID NO: 3201 - DNA, 21 bp, Artificial Sequence
  Description of Artificial Sequence: Synthetic oligonucleotide
aayaayaayaaygayaayaay

SEQ ID NO: 3202 - DNA, 21 bp, Artificial Sequence
  Description of Artificial Sequence: Synthetic oligonucleotide
aayaayaayaayaaygayaay

SEQ ID NO: 3203 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnacn

SEQ ID NO: 3204 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
acnggnggnggn

SEQ ID NO: 3205 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnacnggnggn

SEQ ID NO: 3206 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnacnggn

SEQ ID NO: 3207 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnacn

SEQ ID NO: 3208 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
acnggnggnggnggn

SEQ ID NO: 3209 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnacnggnggnggn

SEQ ID NO: 3210 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnacnggnggn

SEQ ID NO: 3211 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnacnggn

SEQ ID NO: 3212 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnacnacn

SEQ ID NO: 3213 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
acnacnggnggnggn

SEQ ID NO: 3214 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
acnggnacnggnggn

SEQ ID NO: 3215 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
acnggnggnacnggn

SEQ ID NO: 3216 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
acnggnggnggnacn

SEQ ID NO: 3217 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnacnacnggnggn

SEQ ID NO: 3218 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnacnggnacnggn

SEQ ID NO: 3219 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnacnggnggnacn

SEQ ID NO: 3220 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnacnacnggn

SEQ ID NO: 3221 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnacnggnacn

SEQ ID NO: 3222 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggnggnacn

SEQ ID NO: 3223 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
acnggnggnggnggnggn

SEQ ID NO: 3224 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnacnggnggnggnggn

SEQ ID NO: 3225 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnacnggnggnggn

SEQ ID NO: 3226 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnacnggnggn

SEQ ID NO: 3227 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggnacnggn

SEQ ID NO: 3228 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggnacnacn

SEQ ID NO: 3229 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
acnacnggnggnggnggn

SEQ ID NO: 3230 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
acnggnacnggnggnggn

SEQ ID NO: 3231 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
acnggnggnacnggnggn

SEQ ID NO: 3232 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
acnggnggnggnacnggn

SEQ ID NO: 3233 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
acnggnggnggnggnacn

SEQ ID NO: 3234 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnacnacnggnggnggn

SEQ ID NO: 3235 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnacnggnacnggnggn

SEQ ID NO: 3236 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnacnggnggnacnggn

SEQ ID NO: 3237 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnacnggnggnggnacn

SEQ ID NO: 3238 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnacnacnggnggn

SEQ ID NO: 3239 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnacnggnacnggn

SEQ ID NO: 3240 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnacnggnggnacn

SEQ ID NO: 3241 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnacnacnggn

SEQ ID NO: 3242 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnacnggnacn

SEQ ID NO: 3243 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggnacnacnacn

SEQ ID NO: 3244 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnacnacnggnggnggnggn

SEQ ID NO: 3245 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnacnacnggnggnggn

SEQ ID NO: 3246 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnacnggnacnggnggn

SEQ ID NO: 3247 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnacnggnggnacnggn

SEQ ID NO: 3248 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnacnggnggnggnacn

SEQ ID NO: 3249 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnacnacnggnggn

SEQ ID NO: 3250 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnacnggnacnggn

SEQ ID NO: 3251 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnacnggnggnacn

SEQ ID NO: 3252 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnggnacnggnacn

SEQ ID NO: 3253 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnggnacnacnggn

SEQ ID NO: 3254 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnggnggnacnacn

SEQ ID NO: 3255 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnacnggnacnggnggnggn

SEQ ID NO: 3256 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnacnggnggnacnggnggn

SEQ ID NO: 3257 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnacnggnggnggnacnggn

SEQ ID NO: 3258 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnacnggnggnggnggnacn

SEQ ID NO: 3259 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnacnacnggnggnggn

SEQ ID NO: 3260 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnacnggnacnggnggn

SEQ ID NO: 3261 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnacnggnggnacnggn

SEQ ID NO: 3262 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnacnggnggnggnacn

SEQ ID NO: 3263 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnacnacnggnggn

SEQ ID NO: 3264 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnggnacnacnggn

SEQ ID NO: 3265 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnggnggnacnacn

SEQ ID NO: 3266 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnacnggnacnggn

SEQ ID NO: 3267 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnacnggnggnacn

SEQ ID NO: 3268 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnggnacnggnacn

SEQ ID NO: 3269 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnacnacnggnggn

SEQ ID NO: 3270 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnacnggnacnggn

SEQ ID NO: 3271 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnacnggnggnacn

SEQ ID NO: 3272 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnggnacnacnggn

SEQ ID NO: 3273 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnggnacnggnacn

SEQ ID NO: 3274 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnggnggnacnacn

SEQ ID NO: 3275 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnacnacnacnggn

SEQ ID NO: 3276 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnacnacnggnacn

SEQ ID NO: 3277 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnacnggnacnacn

SEQ ID NO: 3278 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggnggnacnacn

SEQ ID NO: 3279 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnacnggnggnggnggnggn

SEQ ID NO: 3280 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnacnggnggnggnggn

SEQ ID NO: 3281 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnacnggnggnggn

SEQ ID NO: 3282 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnggnacnggnggn

SEQ ID NO: 3283 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnggnggnacnggn

SEQ ID NO: 3284 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnggnggnggnacn

SEQ ID NO: 3285 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnacnggnggnggnggn

SEQ ID NO: 3286 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnacnggnggnggn

SEQ ID NO: 3287 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnggnacnggnggn

SEQ ID NO: 3288 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnggnggnacnggn

SEQ ID NO: 3289 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnggnggnggnacn

SEQ ID NO: 3290 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnacnggnggnggn

SEQ ID NO: 3291 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnggnacnggnggn

SEQ ID NO: 3292 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnggnggnacnggn

SEQ ID NO: 3293 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnggnggnggnacn

SEQ ID NO: 3294 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnacnacnggnggn

SEQ ID NO: 3295 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnacnggnacnggn

SEQ ID NO: 3296 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnacnggnggnacn

SEQ ID NO: 3297 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggnacnacnggn

SEQ ID NO: 3298 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggnacnggnacn

SEQ ID NO: 3299 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggnggnggnacn

SEQ ID NO: 3300 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
acnggnggnggnggnggnggn

SEQ ID NO: 3301 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnacnggnggnggnggnggn

SEQ ID NO: 3302 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnacnggnggnggnggn

SEQ ID NO: 3303 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnacnggnggnggn

SEQ ID NO: 3304 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggnacnggnggn

SEQ ID NO: 3305 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggnggnacnggn

SEQ ID NO: 3306 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggngcn

SEQ ID NO: 3307 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
gcnggnggnggn

SEQ ID NO: 3308 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggngcnggnggn

SEQ ID NO: 3309 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggngcnggn

SEQ ID NO: 3310 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggngcn

SEQ ID NO: 3311 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
gcnggnggnggnggn

SEQ ID NO: 3312 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggngcnggnggnggn

SEQ ID NO: 3313 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggngcnggnggn

SEQ ID NO: 3314 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggngcnggn

SEQ ID NO: 3315 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggngcngcn

SEQ ID NO: 3316 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
gcngcnggnggnggn

SEQ ID NO: 3317 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
gcnggngcnggnggn

SEQ ID NO: 3318 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
gcnggnggngcnggn

SEQ ID NO: 3319 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
gcnggnggnggngcn

SEQ ID NO: 3320 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggngcngcnggnggn

SEQ ID NO: 3321 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggngcnggngcnggn

SEQ ID NO: 3322 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggngcnggnggngcn

SEQ ID NO: 3323 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggngcngcnggn

SEQ ID NO: 3324 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggngcnggngcn

SEQ ID NO: 3325 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggnggngcn

SEQ ID NO: 3326 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gcnggnggnggnggnggn

SEQ ID NO: 3327 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngcnggnggnggnggn

SEQ ID NO: 3328 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggngcnggnggnggn

SEQ ID NO: 3329 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggngcnggnggn

SEQ ID NO: 3330 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggngcnggn

SEQ ID NO: 3331 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggngcngcn

SEQ ID NO: 3332 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gcngcnggnggnggnggn

SEQ ID NO: 3333 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gcnggngcnggnggnggn

SEQ ID NO: 3334 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gcnggnggngcnggnggn

SEQ ID NO: 3335 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gcnggnggnggngcnggn

SEQ ID NO: 3336 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gcnggnggnggnggngcn

SEQ ID NO: 3337 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngcngcnggnggnggn

SEQ ID NO: 3338 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngcnggngcnggnggn

SEQ ID NO: 3339 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngcnggnggngcnggn

SEQ ID NO: 3340 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngcnggnggnggngcn

SEQ ID NO: 3341 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggngcngcnggnggn

SEQ ID NO: 3342 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggngcnggngcnggn

SEQ ID NO: 3343 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggngcnggnggngcn

SEQ ID NO: 3344 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggngcngcnggn

SEQ ID NO: 3345 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggngcnggngcn

SEQ ID NO: 3346 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggngcngcngcn

SEQ ID NO: 3347 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcngcngcnggnggnggnggn

SEQ ID NO: 3348 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggngcngcnggnggnggn

SEQ ID NO: 3349 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggngcnggngcnggnggn

SEQ ID NO: 3350 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggngcnggnggngcnggn

SEQ ID NO: 3351 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggngcnggnggnggngcn

SEQ ID NO: 3352 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggngcngcnggnggn

SEQ ID NO: 3353 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggngcnggngcnggn

SEQ ID NO: 3354 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggngcnggnggngcn

SEQ ID NO: 3355 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggnggngcnggngcn

SEQ ID NO: 3356 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggnggngcngcnggn

SEQ ID NO: 3357 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggnggnggngcngcn

SEQ ID NO: 3358 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcngcnggngcnggnggnggn

SEQ ID NO: 3359 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcngcnggnggngcnggnggn

SEQ ID NO: 3360 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcngcnggnggnggngcnggn

SEQ ID NO: 3361 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcngcnggnggnggnggngcn

SEQ ID NO: 3362 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcngcngcnggnggnggn

SEQ ID NO: 3363 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcngcnggngcnggnggn

SEQ ID NO: 3364 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcngcnggnggngcnggn

SEQ ID NO: 3365 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcngcnggnggnggngcn

SEQ ID NO: 3366 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggngcngcnggnggn

SEQ ID NO: 3367 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggnggngcngcnggn

SEQ ID NO: 3368 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggnggnggngcngcn

SEQ ID NO: 3369 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggngcnggngcnggn

SEQ ID NO: 3370 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggngcnggnggngcn

SEQ ID NO: 3371 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggnggngcnggngcn

SEQ ID NO: 3372 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcngcngcnggnggn

SEQ ID NO: 3373 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcngcnggngcnggn

SEQ ID NO: 3374 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcngcnggnggngcn

SEQ ID NO: 3375 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcnggngcngcnggn

SEQ ID NO: 3376 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcnggngcnggngcn

SEQ ID NO: 3377 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcnggnggngcngcn

SEQ ID NO: 3378 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggngcngcngcnggn

SEQ ID NO: 3379 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggngcngcnggngcn

SEQ ID NO: 3380 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggngcnggngcngcn

SEQ ID NO: 3381 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggnggngcngcn

SEQ ID NO: 3382 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcngcnggnggnggnggnggn

SEQ ID NO: 3383 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggngcnggnggnggnggn

SEQ ID NO: 3384 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggngcnggnggnggn

SEQ ID NO: 3385 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggnggngcnggnggn

SEQ ID NO: 3386 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggnggnggngcnggn

SEQ ID NO: 3387 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggnggnggnggngcn

SEQ ID NO: 3388 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcngcnggnggnggnggn

SEQ ID NO: 3389 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggngcnggnggnggn

SEQ ID NO: 3390 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggnggngcnggnggn

SEQ ID NO: 3391 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggnggnggngcnggn

SEQ ID NO: 3392 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggnggnggnggngcn

SEQ ID NO: 3393 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcngcnggnggnggn

SEQ ID NO: 3394 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcnggngcnggnggn

SEQ ID NO: 3395 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcnggnggngcnggn

SEQ ID NO: 3396 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcnggnggnggngcn

SEQ ID NO: 3397 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggngcngcnggnggn

SEQ ID NO: 3398 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggngcnggngcnggn

SEQ ID NO: 3399 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggngcnggnggngcn

SEQ ID NO: 3400 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggngcngcnggn

SEQ ID NO: 3401 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggngcnggngcn

SEQ ID NO: 3402 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggnggnggngcn

SEQ ID NO: 3403 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gcnggnggnggnggnggnggn

SEQ ID NO: 3404 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngcnggnggnggnggnggn

SEQ ID NO: 3405 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngcnggnggnggnggn

SEQ ID NO: 3406 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggngcnggnggnggn

SEQ ID NO: 3407 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggngcnggnggn

SEQ ID NO: 3408 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnggnggngcnggn

SEQ ID NO: 3409 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggnagy

SEQ ID NO: 3410 - DNA, 12 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
agyggnggnggn

SEQ ID NO: 3411 - DNA, 12 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggnagyggnggn

SEQ ID NO: 3412 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggnagyggn

SEQ ID NO: 3413 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggnagy

SEQ ID NO: 3414 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
agyggnggnggnggn

SEQ ID NO: 3415 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnagyggnggnggn

SEQ ID NO: 3416 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggnagyggnggn

SEQ ID NO: 3417 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggnagyggn

SEQ ID NO: 3418 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggnagyagy

SEQ ID NO: 3419 - DNA, 15 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
agyagyggnggnggn

SEQ ID NO: 3420 - DNA, 15 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
agyggnagyggnggn

SEQ ID NO: 3421 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
agyggnggnagyggn

SEQ ID NO: 3422 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
agyggnggnggnagy

SEQ ID NO: 3423 - DNA, 15 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
ggnagyagyggnggn

SEQ ID NO: 3424 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
ggnagyggnagyggn

SEQ ID NO: 3425 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggnagyggnggnagy

SEQ ID NO: 3426 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
ggnggnagyagyggn

SEQ ID NO: 3427 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggnagyggnagy

SEQ ID NO: 3428 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggnagy

SEQ ID NO: 3429 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
agyggnggnggnggnggn

SEQ ID NO: 3430 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnagyggnggnggnggn

SEQ ID NO: 3431 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnagyggnggnggn

SEQ ID NO: 3432 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggnagyggnggn

SEQ ID NO: 3433 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggnagyggn

SEQ ID NO: 3434 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggnagyagy

SEQ ID NO: 3435 - DNA, 18 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
agyagyggnggnggnggn

SEQ ID NO: 3436 - DNA, 18 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
agyggnagyggnggnggn

SEQ ID NO: 3437 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
agyggnggnagyggnggn

SEQ ID NO: 3438 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
agyggnggnggnagyggn

SEQ ID NO: 3439 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
agyggnggnggnggnagy

SEQ ID NO: 3440 - DNA, 18 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnagyagyggnggnggn

SEQ ID NO: 3441 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnagyggnagyggnggn

SEQ ID NO: 3442 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnagyggnggnagyggn

SEQ ID NO: 3443 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnagyggnggnggnagy

SEQ ID NO: 3444 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggnagyagyggnggn

SEQ ID NO: 3445 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggnagyggnagyggn

SEQ ID NO: 3446 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggnagyggnggnagy

SEQ ID NO: 3447 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggnagyagyggn

SEQ ID NO: 3448 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggnagyggnagy

SEQ ID NO: 3449 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggnagyagyagy

SEQ ID NO: 3450 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
agyagyagyggnggnggnggn

SEQ ID NO: 3451 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
agyggnagyagyggnggnggn

SEQ ID NO: 3452 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
agyggnagyggnagyggnggn

SEQ ID NO: 3453 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
agyggnagyggnggnagyggn

SEQ ID NO: 3454 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
agyggnagyggnggnggnagy

SEQ ID NO: 3455 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
agyggnggnagyagyggnggn

SEQ ID NO: 3456 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
agyggnggnagyggnagyggn

SEQ ID NO: 3457 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
agyggnggnagyggnggnagy

SEQ ID NO: 3458 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
agyggnggnggnagyggnagy

SEQ ID NO: 3459 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
agyggnggnggnagyagyggn

SEQ ID NO: 3460 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
agyggnggnggnggnagyagy

SEQ ID NO: 3461 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
agyagyggnagyggnggnggn

SEQ ID NO: 3462 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
agyagyggnggnagyggnggn

SEQ ID NO: 3463 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
agyagyggnggnggnagyggn

SEQ ID NO: 3464 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
agyagyggnggnggnggnagy

SEQ ID NO: 3465 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnagyagyagyggnggnggn

SEQ ID NO: 3466 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnagyagyggnagyggnggn

SEQ ID NO: 3467 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnagyagyggnggnagyggn

SEQ ID NO: 3468 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnagyagyggnggnggnagy

SEQ ID NO: 3469 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggnagyggnagyagyggnggn

SEQ ID NO: 3470 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggnagyggnggnagyagyggn

SEQ ID NO: 3471 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnagyggnggnggnagyagy

SEQ ID NO: 3472 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggnagyggnagyggnagyggn

SEQ ID NO: 3473 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnagyggnagyggnggnagy

SEQ ID NO: 3474 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnagyggnggnagyggnagy

SEQ ID NO: 3475 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (18)..(18): a, c, g, t, unknown or other
  modified_base (21)..(21): a, c, g, t, unknown or other
ggnggnagyagyagyggnggn

SEQ ID NO: 3476 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (21)..(21): a, c, g, t, unknown or other
ggnggnagyagyggnagyggn

SEQ ID NO: 3477 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggnagyagyggnggnagy

SEQ ID NO: 3478 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (21)..(21): a, c, g, t, unknown or other
ggnggnagyggnagyagyggn

SEQ ID NO: 3479 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggnagyggnagyggnagy

SEQ ID NO: 3480 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggnagyggnggnagyagy

SEQ ID NO: 3481 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (21)..(21): a, c, g, t, unknown or other
ggnggnggnagyagyagyggn

SEQ ID NO: 3482 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggnagyagyggnagy

SEQ ID NO: 3483 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggnagyggnagyagy

SEQ ID NO: 3484 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggnagyagy

SEQ ID NO: 3485 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
agyagyggnggnggnggnggn

SEQ ID NO: 3486 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
agyggnagyggnggnggnggn

SEQ ID NO: 3487 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
agyggnggnagyggnggnggn

SEQ ID NO: 3488 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
agyggnggnggnagyggnggn

SEQ ID NO: 3489 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
agyggnggnggnggnagyggn

SEQ ID NO: 3490 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
agyggnggnggnggnggnagy

SEQ ID NO: 3491 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnagyagyggnggnggnggn

SEQ ID NO: 3492 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnagyggnagyggnggnggn

SEQ ID NO: 3493 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnagyggnggnagyggnggn

SEQ ID NO: 3494 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnagyggnggnggnagyggn

SEQ ID NO: 3495 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnagyggnggnggnggnagy

SEQ ID NO: 3496 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnagyagyggnggnggn

SEQ ID NO: 3497 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggnagyggnagyggnggn

SEQ ID NO: 3498 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggnagyggnggnagyggn

SEQ ID NO: 3499 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnagyggnggnggnagy

SEQ ID NO: 3500 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggnggnggnagyagyggnggn

SEQ ID NO: 3501 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggnggnggnagyggnagyggn

SEQ ID NO: 3502 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggnagyggnggnagy

SEQ ID NO: 3503 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggnggnggnggnagyagyggn

SEQ ID NO: 3504 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggnagyggnagy

SEQ ID NO: 3505 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggnggnggnagy

SEQ ID NO: 3506 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
agyggnggnggnggnggnggn

SEQ ID NO: 3507 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnagyggnggnggnggnggn

SEQ ID NO: 3508 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnagyggnggnggnggn

SEQ ID NO: 3509 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnagyggnggnggn

SEQ ID NO: 3510 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggnggnggnagyggnggn

SEQ ID NO: 3511 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggnggnggnggnagyggn

SEQ ID NO: 3512 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggncar

SEQ ID NO: 3513 - DNA, 12 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
carggnggnggn

SEQ ID NO: 3514 - DNA, 12 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggncarggnggn

SEQ ID NO: 3515 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggncarggn

SEQ ID NO: 3516 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggncar

SEQ ID NO: 3517 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
carggnggnggnggn

SEQ ID NO: 3518 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggncarggnggnggn

SEQ ID NO: 3519 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggncarggnggn

SEQ ID NO: 3520 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggncarggn

SEQ ID NO: 3521 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggncarcar

SEQ ID NO: 3522 - DNA, 15 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
carcarggnggnggn

SEQ ID NO: 3523 - DNA, 15 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
carggncarggnggn

SEQ ID NO: 3524 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
carggnggncarggn

SEQ ID NO: 3525 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
carggnggnggncar

SEQ ID NO: 3526 - DNA, 15 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
ggncarcarggnggn

SEQ ID NO: 3527 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
ggncarggncarggn

SEQ ID NO: 3528 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggncarggnggncar

SEQ ID NO: 3529 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
ggnggncarcarggn

SEQ ID NO: 3530 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggncarggncar

SEQ ID NO: 3531 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggncar

SEQ ID NO: 3532 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
carggnggnggnggnggn

SEQ ID NO: 3533 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggncarggnggnggnggn

SEQ ID NO: 3534 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggncarggnggnggn

SEQ ID NO: 3535 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggncarggnggn

SEQ ID NO: 3536 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggncarggn

SEQ ID NO: 3537 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggncarcar

SEQ ID NO: 3538 - DNA, 18 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
carcarggnggnggnggn

SEQ ID NO: 3539 - DNA, 18 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
carggncarggnggnggn

SEQ ID NO: 3540 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
carggnggncarggnggn

SEQ ID NO: 3541 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
carggnggnggncarggn

SEQ ID NO: 3542 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
carggnggnggnggncar

SEQ ID NO: 3543 - DNA, 18 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggncarcarggnggnggn

SEQ ID NO: 3544 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggncarggncarggnggn

SEQ ID NO: 3545 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggncarggnggncarggn

SEQ ID NO: 3546 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggncarggnggnggncar

SEQ ID NO: 3547 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggncarcarggnggn

SEQ ID NO: 3548 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggncarggncarggn

SEQ ID NO: 3549 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggncarggnggncar

SEQ ID NO: 3550 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggncarcarggn

SEQ ID NO: 3551 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggncarggncar

SEQ ID NO: 3552 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggncarcarcar

SEQ ID NO: 3553 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
carcarcarggnggnggnggn

SEQ ID NO: 3554 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
carggncarcarggnggnggn

SEQ ID NO: 3555 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
carggncarggncarggnggn

SEQ ID NO: 3556 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
carggncarggnggncarggn

SEQ ID NO: 3557 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
carggncarggnggnggncar

SEQ ID NO: 3558 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
carggnggncarcarggnggn

SEQ ID NO: 3559 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
carggnggncarggncarggn

SEQ ID NO: 3560 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
carggnggncarggnggncar

SEQ ID NO: 3561 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
carggnggnggncarggncar

SEQ ID NO: 3562 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
carggnggnggncarcarggn

SEQ ID NO: 3563 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
carggnggnggnggncarcar

SEQ ID NO: 3564 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
carcarggncarggnggnggn

SEQ ID NO: 3565 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
carcarggnggncarggnggn

SEQ ID NO: 3566 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
carcarggnggnggncarggn

SEQ ID NO: 3567 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
carcarggnggnggnggncar

SEQ ID NO: 3568 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggncarcarcarggnggnggn

SEQ ID NO: 3569 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggncarcarggncarggnggn

SEQ ID NO: 3570 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggncarcarggnggncarggn

SEQ ID NO: 3571 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggncarcarggnggnggncar

SEQ ID NO: 3572 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggncarggncarcarggnggn

SEQ ID NO: 3573 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggncarggnggncarcarggn

SEQ ID NO: 3574 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggncarggnggnggncarcar

SEQ ID NO: 3575 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggncarggncarggncarggn

SEQ ID NO: 3576 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggncarggncarggnggncar

SEQ ID NO: 3577 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggncarggnggncarggncar

SEQ ID NO: 3578 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (18)..(18): a, c, g, t, unknown or other
  modified_base (21)..(21): a, c, g, t, unknown or other
ggnggncarcarcarggnggn

SEQ ID NO: 3579 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (21)..(21): a, c, g, t, unknown or other
ggnggncarcarggncarggn

SEQ ID NO: 3580 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggncarcarggnggncar

SEQ ID NO: 3581 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (21)..(21): a, c, g, t, unknown or other
ggnggncarggncarcarggn

SEQ ID NO: 3582 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggncarggncarggncar

SEQ ID NO: 3583 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggncarggnggncarcar

SEQ ID NO: 3584 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (21)..(21): a, c, g, t, unknown or other
ggnggnggncarcarcarggn

SEQ ID NO: 3585 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggncarcarggncar

SEQ ID NO: 3586 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggncarggncarcar

SEQ ID NO: 3587 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggncarcar

SEQ ID NO: 3588 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
carcarggnggnggnggnggn

SEQ ID NO: 3589 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
carggncarggnggnggnggn

SEQ ID NO: 3590 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
carggnggncarggnggnggn

SEQ ID NO: 3591 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
carggnggnggncarggnggn

SEQ ID NO: 3592 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
carggnggnggnggncarggn

SEQ ID NO: 3593 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
carggnggnggnggnggncar

SEQ ID NO: 3594 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggncarcarggnggnggnggn

SEQ ID NO: 3595 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggncarggncarggnggnggn

SEQ ID NO: 3596 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggncarggnggncarggnggn

SEQ ID NO: 3597 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggncarggnggnggncarggn

SEQ ID NO: 3598 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggncarggnggnggnggncar

SEQ ID NO: 3599 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggncarcarggnggnggn

SEQ ID NO: 3600 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggncarggncarggnggn

SEQ ID NO: 3601 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggncarggnggncarggn

SEQ ID NO: 3602 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggncarggnggnggncar

SEQ ID NO: 3603 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggnggnggncarcarggnggn

SEQ ID NO: 3604 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggnggnggncarggncarggn

SEQ ID NO: 3605 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggncarggnggncar

SEQ ID NO: 3606 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggnggnggnggncarcarggn

SEQ ID NO: 3607 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggncarggncar

SEQ ID NO: 3608 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggnggnggncar

SEQ ID NO: 3609 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
carggnggnggnggnggnggn

SEQ ID NO: 3610 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggncarggnggnggnggnggn

SEQ ID NO: 3611 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggncarggnggnggnggn

SEQ ID NO: 3612 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggncarggnggnggn

SEQ ID NO: 3613 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggnggnggncarggnggn

SEQ ID NO: 3614 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggnggnggnggncarggn

SEQ ID NO: 3615 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggngar

SEQ ID NO: 3616 - DNA, 12 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
garggnggnggn

SEQ ID NO: 3617 - DNA, 12 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggngarggnggn

SEQ ID NO: 3618 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggngarggn

SEQ ID NO: 3619 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggngar

SEQ ID NO: 3620 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
garggnggnggnggn

SEQ ID NO: 3621 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggngarggnggnggn

SEQ ID NO: 3622 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggngarggnggn

SEQ ID NO: 3623 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggngarggn

SEQ ID NO: 3624 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggngargar

SEQ ID NO: 3625 - DNA, 15 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
gargarggnggnggn

SEQ ID NO: 3626 - DNA, 15 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
garggngarggnggn

SEQ ID NO: 3627 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
garggnggngarggn

SEQ ID NO: 3628 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
garggnggnggngar

SEQ ID NO: 3629 - DNA, 15 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
ggngargarggnggn

SEQ ID NO: 3630 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
ggngarggngarggn

SEQ ID NO: 3631 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggngarggnggngar

SEQ ID NO: 3632 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
ggnggngargarggn

SEQ ID NO: 3633 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggngarggngar

SEQ ID NO: 3634 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggngar

SEQ ID NO: 3635 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
garggnggnggnggnggn

SEQ ID NO: 3636 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngarggnggnggnggn

SEQ ID NO: 3637 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggngarggnggnggn

SEQ ID NO: 3638 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggngarggnggn

SEQ ID NO: 3639 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggngarggn

SEQ ID NO: 3640 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggngargar

SEQ ID NO: 3641 - DNA, 18 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gargarggnggnggnggn

SEQ ID NO: 3642 - DNA, 18 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
garggngarggnggnggn

SEQ ID NO: 3643 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
garggnggngarggnggn

SEQ ID NO: 3644 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
garggnggnggngarggn

SEQ ID NO: 3645 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
garggnggnggnggngar

SEQ ID NO: 3646 - DNA, 18 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngargarggnggnggn

SEQ ID NO: 3647 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggngarggngarggnggn

SEQ ID NO: 3648 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggngarggnggngarggn

SEQ ID NO: 3649 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggngarggnggnggngar

SEQ ID NO: 3650 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggngargarggnggn

SEQ ID NO: 3651 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggngarggngarggn

SEQ ID NO: 3652 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggngarggnggngar

SEQ ID NO: 3653 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggngargarggn

SEQ ID NO: 3654 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggngarggngar

SEQ ID NO: 3655 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggngargargar

SEQ ID NO: 3656 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gargargarggnggnggnggn

SEQ ID NO: 3657 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
garggngargarggnggnggn

SEQ ID NO: 3658 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
garggngarggngarggnggn

SEQ ID NO: 3659 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
garggngarggnggngarggn

SEQ ID NO: 3660 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
garggngarggnggnggngar

SEQ ID NO: 3661 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
garggnggngargarggnggn

SEQ ID NO: 3662 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
garggnggngarggngarggn

SEQ ID NO: 3663 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
garggnggngarggnggngar

SEQ ID NO: 3664 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
garggnggnggngarggngar

SEQ ID NO: 3665 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
garggnggnggngargarggn

SEQ ID NO: 3666 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
garggnggnggnggngargar

SEQ ID NO: 3667 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gargarggngarggnggnggn

SEQ ID NO: 3668 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
gargarggnggngarggnggn

SEQ ID NO: 3669 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
gargarggnggnggngarggn

SEQ ID NO: 3670 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gargarggnggnggnggngar

SEQ ID NO: 3671 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngargargarggnggnggn

SEQ ID NO: 3672 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggngargarggngarggnggn

SEQ ID NO: 3673 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggngargarggnggngarggn

SEQ ID NO: 3674 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngargarggnggnggngar

SEQ ID NO: 3675 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggngarggngargarggnggn

SEQ ID NO: 3676 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggngarggnggngargarggn

SEQ ID NO: 3677 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggngarggnggnggngargar

SEQ ID NO: 3678 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggngarggngarggngarggn

SEQ ID NO: 3679 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggngarggngarggnggngar

SEQ ID NO: 3680 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggngarggnggngarggngar

SEQ ID NO: 3681 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (18)..(18): a, c, g, t, unknown or other
  modified_base (21)..(21): a, c, g, t, unknown or other
ggnggngargargarggnggn

SEQ ID NO: 3682 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (21)..(21): a, c, g, t, unknown or other
ggnggngargarggngarggn

SEQ ID NO: 3683 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggngargarggnggngar

SEQ ID NO: 3684 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (21)..(21): a, c, g, t, unknown or other
ggnggngarggngargarggn

SEQ ID NO: 3685 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggngarggngarggngar

SEQ ID NO: 3686 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggngarggnggngargar

SEQ ID NO: 3687 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (21)..(21): a, c, g, t, unknown or other
ggnggnggngargargarggn

SEQ ID NO: 3688 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggngargarggngar

SEQ ID NO: 3689 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggngarggngargar

SEQ ID NO: 3690 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggngargar

SEQ ID NO: 3691 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gargarggnggnggnggnggn

SEQ ID NO: 3692 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
garggngarggnggnggnggn

SEQ ID NO: 3693 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
garggnggngarggnggnggn

SEQ ID NO: 3694 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
garggnggnggngarggnggn

SEQ ID NO: 3695 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
garggnggnggnggngarggn

SEQ ID NO: 3696 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
garggnggnggnggnggngar

SEQ ID NO: 3697 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngargarggnggnggnggn

SEQ ID NO: 3698 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngarggngarggnggnggn

SEQ ID NO: 3699 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggngarggnggngarggnggn

SEQ ID NO: 3700 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggngarggnggnggngarggn

SEQ ID NO: 3701 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngarggnggnggnggngar

SEQ ID NO: 3702 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngargarggnggnggn

SEQ ID NO: 3703 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggngarggngarggnggn

SEQ ID NO: 3704 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggngarggnggngarggn

SEQ ID NO: 3705 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggngarggnggnggngar

SEQ ID NO: 3706 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggnggnggngargarggnggn

SEQ ID NO: 3707 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggnggnggngarggngarggn

SEQ ID NO: 3708 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggngarggnggngar

SEQ ID NO: 3709 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggnggnggnggngargarggn

SEQ ID NO: 3710 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggngarggngar

SEQ ID NO: 3711 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggnggnggngar

SEQ ID NO: 3712 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
garggnggnggnggnggnggn

SEQ ID NO: 3713 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngarggnggnggnggnggn

SEQ ID NO: 3714 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngarggnggnggnggn

SEQ ID NO: 3715 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggngarggnggnggn

SEQ ID NO: 3716 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggnggnggngarggnggn

SEQ ID NO: 3717 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggnggnggnggngarggn

SEQ ID NO: 3718 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggncay

SEQ ID NO: 3719 - DNA, 12 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
cayggnggnggn

SEQ ID NO: 3720 - DNA, 12 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggncayggnggn

SEQ ID NO: 3721 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggncayggn

SEQ ID NO: 3722 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggncay

SEQ ID NO: 3723 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
cayggnggnggnggn

SEQ ID NO: 3724 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggncayggnggnggn

SEQ ID NO: 3725 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggncayggnggn

SEQ ID NO: 3726 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggncayggn

SEQ ID NO: 3727 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggncaycay

SEQ ID NO: 3728 - DNA, 15 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
caycayggnggnggn

SEQ ID NO: 3729 - DNA, 15 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
cayggncayggnggn

SEQ ID NO: 3730 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
cayggnggncayggn

SEQ ID NO: 3731 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
cayggnggnggncay

SEQ ID NO: 3732 - DNA, 15 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
ggncaycayggnggn

SEQ ID NO: 3733 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
ggncayggncayggn

SEQ ID NO: 3734 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggncayggnggncay

SEQ ID NO: 3735 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
ggnggncaycayggn

SEQ ID NO: 3736 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggncayggncay

SEQ ID NO: 3737 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggncay

SEQ ID NO: 3738 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
cayggnggnggnggnggn

SEQ ID NO: 3739 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggncayggnggnggnggn

SEQ ID NO: 3740 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggncayggnggnggn

SEQ ID NO: 3741 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggncayggnggn

SEQ ID NO: 3742 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggncayggn

SEQ ID NO: 3743 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggncaycay

SEQ ID NO: 3744 - DNA, 18 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
caycayggnggnggnggn

SEQ ID NO: 3745 - DNA, 18 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
cayggncayggnggnggn

SEQ ID NO: 3746 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
cayggnggncayggnggn

SEQ ID NO: 3747 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
cayggnggnggncayggn

SEQ ID NO: 3748 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
cayggnggnggnggncay

SEQ ID NO: 3749 - DNA, 18 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggncaycayggnggnggn

SEQ ID NO: 3750 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggncayggncayggnggn

SEQ ID NO: 3751 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggncayggnggncayggn

SEQ ID NO: 3752 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggncayggnggnggncay

SEQ ID NO: 3753 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggncaycayggnggn

SEQ ID NO: 3754 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggncayggncayggn

SEQ ID NO: 3755 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggncayggnggncay

SEQ ID NO: 3756 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggncaycayggn

SEQ ID NO: 3757 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggncayggncay

SEQ ID NO: 3758 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggncaycaycay

SEQ ID NO: 3759 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
caycaycayggnggnggnggn

SEQ ID NO: 3760 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
cayggncaycayggnggnggn

SEQ ID NO: 3761 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
cayggncayggncayggnggn

SEQ ID NO: 3762 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
cayggncayggnggncayggn

SEQ ID NO: 3763 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
cayggncayggnggnggncay

SEQ ID NO: 3764 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
cayggnggncaycayggnggn

SEQ ID NO: 3765 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
cayggnggncayggncayggn

SEQ ID NO: 3766 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
cayggnggncayggnggncay

SEQ ID NO: 3767 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
cayggnggnggncayggncay

SEQ ID NO: 3768 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
cayggnggnggncaycayggn

SEQ ID NO: 3769 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
cayggnggnggnggncaycay

SEQ ID NO: 3770 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
caycayggncayggnggnggn

SEQ ID NO: 3771 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
caycayggnggncayggnggn

SEQ ID NO: 3772 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
caycayggnggnggncayggn

SEQ ID NO: 3773 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
caycayggnggnggnggncay

SEQ ID NO: 3774 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggncaycaycayggnggnggn

SEQ ID NO: 3775 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggncaycayggncayggnggn

SEQ ID NO: 3776 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggncaycayggnggncayggn

SEQ ID NO: 3777 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggncaycayggnggnggncay

SEQ ID NO: 3778 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggncayggncaycayggnggn

SEQ ID NO: 3779 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggncayggnggncaycayggn

SEQ ID NO: 3780 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggncayggnggnggncaycay

SEQ ID NO: 3781 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggncayggncayggncayggn

SEQ ID NO: 3782 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggncayggncayggnggncay

SEQ ID NO: 3783 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggncayggnggncayggncay

SEQ ID NO: 3784 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (18)..(18): a, c, g, t, unknown or other
  modified_base (21)..(21): a, c, g, t, unknown or other
ggnggncaycaycayggnggn

SEQ ID NO: 3785 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (21)..(21): a, c, g, t, unknown or other
ggnggncaycayggncayggn

SEQ ID NO: 3786 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggncaycayggnggncay

SEQ ID NO: 3787 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (21)..(21): a, c, g, t, unknown or other
ggnggncayggncaycayggn

SEQ ID NO: 3788 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggncayggncayggncay

SEQ ID NO: 3789 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggncayggnggncaycay

SEQ ID NO: 3790 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (21)..(21): a, c, g, t, unknown or other
ggnggnggncaycaycayggn

SEQ ID NO: 3791 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggncaycayggncay

SEQ ID NO: 3792 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggncayggncaycay

SEQ ID NO: 3793 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggncaycay

SEQ ID NO: 3794 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
caycayggnggnggnggnggn

SEQ ID NO: 3795 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
cayggncayggnggnggnggn

SEQ ID NO: 3796 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
cayggnggncayggnggnggn

SEQ ID NO: 3797 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
cayggnggnggncayggnggn

SEQ ID NO: 3798 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
cayggnggnggnggncayggn

SEQ ID NO: 3799 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
cayggnggnggnggnggncay

SEQ ID NO: 3800 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggncaycayggnggnggnggn

SEQ ID NO: 3801 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggncayggncayggnggnggn

SEQ ID NO: 3802 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggncayggnggncayggnggn

SEQ ID NO: 3803 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggncayggnggnggncayggn

SEQ ID NO: 3804 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggncayggnggnggnggncay

SEQ ID NO: 3805 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggncaycayggnggnggn

SEQ ID NO: 3806 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggncayggncayggnggn

SEQ ID NO: 3807 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggncayggnggncayggn

SEQ ID NO: 3808 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggncayggnggnggncay

SEQ ID NO: 3809 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggnggnggncaycayggnggn

SEQ ID NO: 3810 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggnggnggncayggncayggn

SEQ ID NO: 3811 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggncayggnggncay

SEQ ID NO: 3812 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggnggnggnggncaycayggn

SEQ ID NO: 3813 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggncayggncay

SEQ ID NO: 3814 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggnggnggncay

SEQ ID NO: 3815 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
cayggnggnggnggnggnggn

SEQ ID NO: 3816 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggncayggnggnggnggnggn

SEQ ID NO: 3817 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggncayggnggnggnggn

SEQ ID NO: 3818 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggncayggnggnggn

SEQ ID NO: 3819 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggnggnggncayggnggn

SEQ ID NO: 3820 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggnggnggnggncayggn

SEQ ID NO: 3821 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggnaay

SEQ ID NO: 3822 - DNA, 12 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
aayggnggnggn

SEQ ID NO: 3823 - DNA, 12 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggnaayggnggn

SEQ ID NO: 3824 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggnaayggn

SEQ ID NO: 3825 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggnaay

SEQ ID NO: 3826 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
aayggnggnggnggn

SEQ ID NO: 3827 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnaayggnggnggn

SEQ ID NO: 3828 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggnaayggnggn

SEQ ID NO: 3829 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggnaayggn

SEQ ID NO: 3830 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggnaayaay

SEQ ID NO: 3831 - DNA, 15 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
aayaayggnggnggn

SEQ ID NO: 3832 - DNA, 15 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
aayggnaayggnggn

SEQ ID NO: 3833 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
aayggnggnaayggn

SEQ ID NO: 3834 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
aayggnggnggnaay

SEQ ID NO: 3835 - DNA, 15 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
ggnaayaayggnggn

SEQ ID NO: 3836 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
ggnaayggnaayggn

SEQ ID NO: 3837 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggnaayggnggnaay

SEQ ID NO: 3838 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
ggnggnaayaayggn

SEQ ID NO: 3839 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggnaayggnaay

SEQ ID NO: 3840 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggnaay

SEQ ID NO: 3841 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
aayggnggnggnggnggn

SEQ ID NO: 3842 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnaayggnggnggnggn

SEQ ID NO: 3843 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnaayggnggnggn

SEQ ID NO: 3844 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggnaayggnggn

SEQ ID NO: 3845 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggnaayggn

SEQ ID NO: 3846 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggnaayaay

SEQ ID NO: 3847 - DNA, 18 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
aayaayggnggnggnggn

SEQ ID NO: 3848 - DNA, 18 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
aayggnaayggnggnggn

SEQ ID NO: 3849 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
aayggnggnaayggnggn

SEQ ID NO: 3850 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
aayggnggnggnaayggn

SEQ ID NO: 3851 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
aayggnggnggnggnaay

SEQ ID NO: 3852 - DNA, 18 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnaayaayggnggnggn

SEQ ID NO: 3853 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnaayggnaayggnggn

SEQ ID NO: 3854 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnaayggnggnaayggn

SEQ ID NO: 3855 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnaayggnggnggnaay

SEQ ID NO: 3856 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggnaayaayggnggn

SEQ ID NO: 3857 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggnaayggnaayggn

SEQ ID NO: 3858 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggnaayggnggnaay

SEQ ID NO: 3859 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggnaayaayggn

SEQ ID NO: 3860 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggnaayggnaay

SEQ ID NO: 3861 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggnaayaayaay

SEQ ID NO: 3862 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
aayaayaayggnggnggnggn

SEQ ID NO: 3863 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
aayggnaayaayggnggnggn

SEQ ID NO: 3864 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
aayggnaayggnaayggnggn

SEQ ID NO: 3865 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
aayggnaayggnggnaayggn

SEQ ID NO: 3866 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
aayggnaayggnggnggnaay

SEQ ID NO: 3867 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
aayggnggnaayaayggnggn

SEQ ID NO: 3868 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
aayggnggnaayggnaayggn

SEQ ID NO: 3869 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
aayggnggnaayggnggnaay

SEQ ID NO: 3870 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
aayggnggnggnaayggnaay

SEQ ID NO: 3871 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
aayggnggnggnaayaayggn

SEQ ID NO: 3872 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
aayggnggnggnggnaayaay

SEQ ID NO: 3873 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
aayaayggnaayggnggnggn

SEQ ID NO: 3874 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
aayaayggnggnaayggnggn

SEQ ID NO: 3875 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
aayaayggnggnggnaayggn

SEQ ID NO: 3876 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
aayaayggnggnggnggnaay

SEQ ID NO: 3877 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnaayaayaayggnggnggn

SEQ ID NO: 3878 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnaayaayggnaayggnggn

SEQ ID NO: 3879 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnaayaayggnggnaayggn

SEQ ID NO: 3880 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnaayaayggnggnggnaay

SEQ ID NO: 3881 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggnaayggnaayaayggnggn

SEQ ID NO: 3882 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggnaayggnggnaayaayggn

SEQ ID NO: 3883 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnaayggnggnggnaayaay

SEQ ID NO: 3884 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggnaayggnaayggnaayggn

SEQ ID NO: 3885 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnaayggnaayggnggnaay

SEQ ID NO: 3886 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnaayggnggnaayggnaay

SEQ ID NO: 3887 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (18)..(18): a, c, g, t, unknown or other
  modified_base (21)..(21): a, c, g, t, unknown or other
ggnggnaayaayaayggnggn

SEQ ID NO: 3888 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (21)..(21): a, c, g, t, unknown or other
ggnggnaayaayggnaayggn

SEQ ID NO: 3889 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggnaayaayggnggnaay

SEQ ID NO: 3890 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (21)..(21): a, c, g, t, unknown or other
ggnggnaayggnaayaayggn

SEQ ID NO: 3891 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggnaayggnaayggnaay

SEQ ID NO: 3892 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggnaayggnggnaayaay

SEQ ID NO: 3893 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (21)..(21): a, c, g, t, unknown or other
ggnggnggnaayaayaayggn

SEQ ID NO: 3894 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggnaayaayggnaay

SEQ ID NO: 3895 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggnaayggnaayaay

SEQ ID NO: 3896 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggnaayaay

SEQ ID NO: 3897 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
aayaayggnggnggnggnggn

SEQ ID NO: 3898 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
aayggnaayggnggnggnggn

SEQ ID NO: 3899 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
aayggnggnaayggnggnggn

SEQ ID NO: 3900 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
aayggnggnggnaayggnggn

SEQ ID NO: 3901 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
aayggnggnggnggnaayggn

SEQ ID NO: 3902 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
aayggnggnggnggnggnaay

SEQ ID NO: 3903 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnaayaayggnggnggnggn

SEQ ID NO: 3904 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnaayggnaayggnggnggn

SEQ ID NO: 3905 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnaayggnggnaayggnggn

SEQ ID NO: 3906 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnaayggnggnggnaayggn

SEQ ID NO: 3907 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnaayggnggnggnggnaay

SEQ ID NO: 3908 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnaayaayggnggnggn

SEQ ID NO: 3909 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggnaayggnaayggnggn

SEQ ID NO: 3910 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggnaayggnggnaayggn

SEQ ID NO: 3911 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnaayggnggnggnaay

SEQ ID NO: 3912 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggnggnggnaayaayggnggn

SEQ ID NO: 3913 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggnggnggnaayggnaayggn

SEQ ID NO: 3914 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggnaayggnggnaay

SEQ ID NO: 3915 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggnggnggnggnaayaayggn

SEQ ID NO: 3916 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggnaayggnaay

SEQ ID NO: 3917 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggnggnggnaay

SEQ ID NO: 3918 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
aayggnggnggnggnggnggn

SEQ ID NO: 3919 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnaayggnggnggnggnggn

SEQ ID NO: 3920 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnaayggnggnggnggn

SEQ ID NO: 3921 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggnaayggnggnggn

SEQ ID NO: 3922 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggnggnggnaayggnggn

SEQ ID NO: 3923 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggnggnggnggnaayggn

SEQ ID NO: 3924 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggngay

SEQ ID NO: 3925 - DNA, 12 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
gayggnggnggn

SEQ ID NO: 3926 - DNA, 12 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggngayggnggn

SEQ ID NO: 3927 - DNA, 12 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggngayggn

SEQ ID NO: 3928 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggngay

SEQ ID NO: 3929 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
gayggnggnggnggn

SEQ ID NO: 3930 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggngayggnggnggn

SEQ ID NO: 3931 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggngayggnggn

SEQ ID NO: 3932 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggngayggn

SEQ ID NO: 3933 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
ggnggnggngaygay

SEQ ID NO: 3934 - DNA, 15 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
gaygayggnggnggn

SEQ ID NO: 3935 - DNA, 15 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
gayggngayggnggn

SEQ ID NO: 3936 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
gayggnggngayggn

SEQ ID NO: 3937 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
gayggnggnggngay

SEQ ID NO: 3938 - DNA, 15 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
ggngaygayggnggn

SEQ ID NO: 3939 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
ggngayggngayggn

SEQ ID NO: 3940 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
ggngayggnggngay

SEQ ID NO: 3941 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
ggnggngaygayggn

SEQ ID NO: 3942 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
ggnggngayggngay

SEQ ID NO: 3943 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggngay

SEQ ID NO: 3944 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gayggnggnggnggnggn

SEQ ID NO: 3945 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngayggnggnggnggn

SEQ ID NO: 3946 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggngayggnggnggn

SEQ ID NO: 3947 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggngayggnggn

SEQ ID NO: 3948 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggngayggn

SEQ ID NO: 3949 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggngaygay

SEQ ID NO: 3950 - DNA, 18 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gaygayggnggnggnggn

SEQ ID NO: 3951 - DNA, 18 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gayggngayggnggnggn

SEQ ID NO: 3952 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
gayggnggngayggnggn

SEQ ID NO: 3953 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
gayggnggnggngayggn

SEQ ID NO: 3954 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
gayggnggnggnggngay

SEQ ID NO: 3955 - DNA, 18 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngaygayggnggnggn

SEQ ID NO: 3956 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggngayggngayggnggn

SEQ ID NO: 3957 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggngayggnggngayggn

SEQ ID NO: 3958 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggngayggnggnggngay

SEQ ID NO: 3959 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggngaygayggnggn

SEQ ID NO: 3960 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggngayggngayggn

SEQ ID NO: 3961 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggngayggnggngay

SEQ ID NO: 3962 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggngaygayggn

SEQ ID NO: 3963 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggngayggngay

SEQ ID NO: 3964 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
ggnggnggnggngaygaygay

SEQ ID NO: 3965 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gaygaygayggnggnggnggn

SEQ ID NO: 3966 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gayggngaygayggnggnggn

SEQ ID NO: 3967 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
gayggngayggngayggnggn

SEQ ID NO: 3968 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
gayggngayggnggngayggn

SEQ ID NO: 3969 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gayggngayggnggnggngay

SEQ ID NO: 3970 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
gayggnggngaygayggnggn

SEQ ID NO: 3971 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
gayggnggngayggngayggn

SEQ ID NO: 3972 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
gayggnggngayggnggngay

SEQ ID NO: 3973 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
gayggnggnggngayggngay

SEQ ID NO: 3974 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
gayggnggnggngaygayggn

SEQ ID NO: 3975 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
gayggnggnggnggngaygay

SEQ ID NO: 3976 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gaygayggngayggnggnggn

SEQ ID NO: 3977 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
gaygayggnggngayggnggn

SEQ ID NO: 3978 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
gaygayggnggnggngayggn

SEQ ID NO: 3979 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gaygayggnggnggnggngay

SEQ ID NO: 3980 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngaygaygayggnggnggn

SEQ ID NO: 3981 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggngaygayggngayggnggn

SEQ ID NO: 3982 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggngaygayggnggngayggn

SEQ ID NO: 3983 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngaygayggnggnggngay

SEQ ID NO: 3984 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggngayggngaygayggnggn

SEQ ID NO: 3985 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggngayggnggngaygayggn

SEQ ID NO: 3986 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggngayggnggnggngaygay

SEQ ID NO: 3987 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggngayggngayggngayggn

SEQ ID NO: 3988 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggngayggngayggnggngay

SEQ ID NO: 3989 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggngayggnggngayggngay

SEQ ID NO: 3990 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (18)..(18): a, c, g, t, unknown or other
  modified_base (21)..(21): a, c, g, t, unknown or other
ggnggngaygaygayggnggn

SEQ ID NO: 3991 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (21)..(21): a, c, g, t, unknown or other
ggnggngaygayggngayggn

SEQ ID NO: 3992 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
ggnggngaygayggnggngay

SEQ ID NO: 3993 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (21)..(21): a, c, g, t, unknown or other
ggnggngayggngaygayggn

SEQ ID NO: 3994 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
ggnggngayggngayggngay

SEQ ID NO: 3995 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
ggnggngayggnggngaygay

SEQ ID NO: 3996 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (21)..(21): a, c, g, t, unknown or other
ggnggnggngaygaygayggn

SEQ ID NO: 3997 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
ggnggnggngaygayggngay

SEQ ID NO: 3998 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
ggnggnggngayggngaygay

SEQ ID NO: 3999 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
ggnggnggnggnggngaygay

SEQ ID NO: 4000 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gaygayggnggnggnggnggn

SEQ ID NO: 4001 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gayggngayggnggnggnggn

SEQ ID NO: 4002 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gayggnggngayggnggnggn

SEQ ID NO: 4003 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
gayggnggnggngayggnggn

SEQ ID NO: 4004 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
gayggnggnggnggngayggn

SEQ ID NO: 4005 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
gayggnggnggnggnggngay

SEQ ID NO: 4006 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngaygayggnggnggnggn

SEQ ID NO: 4007 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngayggngayggnggnggn

SEQ ID NO: 4008 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggngayggnggngayggnggn

SEQ ID NO: 4009 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggngayggnggnggngayggn

SEQ ID NO: 4010 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggngayggnggnggnggngay

SEQ ID NO: 4011 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngaygayggnggnggn

SEQ ID NO: 4012 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggngayggngayggnggn

SEQ ID NO: 4013 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggngayggnggngayggn

SEQ ID NO: 4014 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggngayggnggnggngay

SEQ ID NO: 4015 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (18)..(18): a, c, g, t, unknown or other
  modified_base (21)..(21): a, c, g, t, unknown or other
ggnggnggngaygayggnggn

SEQ ID NO: 4016 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (21)..(21): a, c, g, t, unknown or other
ggnggnggngayggngayggn

SEQ ID NO: 4017 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
ggnggnggngayggnggngay

SEQ ID NO: 4018 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (21)..(21): a, c, g, t, unknown or other
ggnggnggnggngaygayggn

SEQ ID NO: 4019 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
ggnggnggnggngayggngay

SEQ ID NO: 4020 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
ggnggnggnggnggnggngay

SEQ ID NO: 4021 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
gayggnggnggnggnggnggn

SEQ ID NO: 4022 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggngayggnggnggnggnggn

SEQ ID NO: 4023 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggngayggnggnggnggn

SEQ ID NO: 4024 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (15)..(15): a, c, g, t, unknown or other
  modified_base (18)..(18): a, c, g, t, unknown or other
  modified_base (21)..(21): a, c, g, t, unknown or other
ggnggnggngayggnggnggn

SEQ ID NO: 4025 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (18)..(18): a, c, g, t, unknown or other
  modified_base (21)..(21): a, c, g, t, unknown or other
ggnggnggnggngayggnggn

SEQ ID NO: 4026 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
  modified_base (12)..(12): a, c, g, t, unknown or other
  modified_base (15)..(15): a, c, g, t, unknown or other
  modified_base (21)..(21): a, c, g, t, unknown or other
ggnggnggnggnggngayggn

SEQ ID NO: 4027 - DNA, 12 bp, Artificial Sequence
  Description of Artificial Sequence: Synthetic oligonucleotide
  modified_base (12)..(12): a, c, g, t, unknown or other
carcarcaracn

SEQ ID NO: 4028 - DNA, 12 bp, Artificial Sequence
  Description of Artificial Sequence: Synthetic oligonucleotide
  modified_base (3)..(3): a, c, g, t, unknown or other
acncarcarcar

SEQ ID NO: 4029 - DNA, 12 bp, Artificial Sequence
  Description of Artificial Sequence: Synthetic oligonucleotide
  modified_base (6)..(6): a, c, g, t, unknown or other
caracncarcar

SEQ ID NO: 4030 - DNA, 12 bp, Artificial Sequence
  Description of Artificial Sequence: Synthetic oligonucleotide
  modified_base (9)..(9): a, c, g, t, unknown or other
carcaracncar

SEQ ID NO: 4031 - DNA, 15 bp, Artificial Sequence
  Description of Artificial Sequence: Synthetic oligonucleotide
  modified_base (15)..(15): a, c, g, t, unknown or other
carcarcarcaracn

SEQ ID NO: 4032 - DNA, 15 bp, Artificial Sequence
  Description of Artificial Sequence: Synthetic oligonucleotide
  modified_base (3)..(3): a, c, g, t, unknown or other
acncarcarcarcar

SEQ ID NO: 4033 - DNA, 15 bp, Artificial Sequence
  Description of Artificial Sequence: Synthetic oligonucleotide
  modified_base (6)..(6): a, c, g, t, unknown or other
caracncarcarcar

SEQ ID NO: 4034 - DNA, 15 bp, Artificial Sequence
  Description of Artificial Sequence: Synthetic oligonucleotide
  modified_base (9)..(9): a, c, g, t, unknown or other
carcaracncarcar

SEQ ID NO: 4035 - DNA, 15 bp, Artificial Sequence
  Description of Artificial Sequence: Synthetic oligonucleotide
  modified_base (12)..(12): a, c, g, t, unknown or other
carcarcaracncar

SEQ ID NO: 4036 - DNA, 15 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
carcarcaracnacn

SEQ ID NO: 4037 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
acnacncarcarcar

SEQ ID NO: 4038 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
acncaracncarcar

SEQ ID NO: 4039 - DNA, 15 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
acncarcaracncar

SEQ ID NO: 4040 - DNA, 15 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
acncarcarcaracn

SEQ ID NO: 4041 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
caracnacncarcar

SEQ ID NO: 4042 - DNA, 15 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
caracncaracncar

SEQ ID NO: 4043 - DNA, 15 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
caracncarcaracn

SEQ ID NO: 4044 - DNA, 15 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
carcaracnacncar

SEQ ID NO: 4045 - DNA, 15 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
carcaracncaracn

SEQ ID NO: 4046 - DNA, 18 bp, Artificial Sequence
  Description of Artificial Sequence: Synthetic oligonucleotide
  modified_base (18)..(18): a, c, g, t, unknown or other
carcarcarcarcaracn

SEQ ID NO: 4047 - DNA, 18 bp, Artificial Sequence
  Description of Artificial Sequence: Synthetic oligonucleotide
  modified_base (3)..(3): a, c, g, t, unknown or other
acncarcarcarcarcar

SEQ ID NO: 4048 - DNA, 18 bp, Artificial Sequence
  Description of Artificial Sequence: Synthetic oligonucleotide
  modified_base (6)..(6): a, c, g, t, unknown or other
caracncarcarcarcar

SEQ ID NO: 4049 - DNA, 18 bp, Artificial Sequence
  Description of Artificial Sequence: Synthetic oligonucleotide
  modified_base (9)..(9): a, c, g, t, unknown or other
carcaracncarcarcar

SEQ ID NO: 4050 - DNA, 18 bp, Artificial Sequence
  Description of Artificial Sequence: Synthetic oligonucleotide
  modified_base (12)..(12): a, c, g, t, unknown or other
carcarcaracncarcar

SEQ ID NO: 4051 - DNA, 18 bp, Artificial Sequence
  Description of Artificial Sequence: Synthetic oligonucleotide
  modified_base (15)..(15): a, c, g, t, unknown or other
carcarcarcaracncar

SEQ ID NO: 4052 - DNA, 18 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
carcarcarcaracnacn

SEQ ID NO: 4053 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
acnacncarcarcarcar

SEQ ID NO: 4054 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
acncaracncarcarcar

SEQ ID NO: 4055 - DNA, 18 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
acncarcaracncarcar

SEQ ID NO: 4056 - DNA, 18 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
acncarcarcaracncar

SEQ ID NO: 4057 - DNA, 18 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
acncarcarcarcaracn

SEQ ID NO: 4058 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
caracnacncarcarcar

SEQ ID NO: 4059 - DNA, 18 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
caracncaracncarcar

SEQ ID NO: 4060 - DNA, 18 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
caracncarcaracncar

SEQ ID NO: 4061 - DNA, 18 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
caracncarcarcaracn

SEQ ID NO: 4062 - DNA, 18 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
carcaracnacncarcar

SEQ ID NO: 4063 - DNA, 18 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
carcaracncaracncar

SEQ ID NO: 4064 - DNA, 18 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
carcaracncarcaracn

SEQ ID NO: 4065 - DNA, 18 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
carcarcaracnacncar

SEQ ID NO: 4066 - DNA, 18 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
carcarcaracncaracn

SEQ ID NO: 4067 - DNA, 21 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
  modified_base (21)..(21): a, c, g, t, unknown or other
carcarcarcaracnacnacn

SEQ ID NO: 4068 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
acnacnacncarcarcarcar

SEQ ID NO: 4069 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
acncaracnacncarcarcar

SEQ ID NO: 4070 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
acncaracncaracncarcar

SEQ ID NO: 4071 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (18)..(18): a, c, g, t, unknown or other
acncaracncarcaracncar

SEQ ID NO: 4072 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (21)..(21): a, c, g, t, unknown or other
acncaracncarcarcaracn

SEQ ID NO: 4073 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
acncarcaracnacncarcar

SEQ ID NO: 4074 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (18)..(18): a, c, g, t, unknown or other
acncarcaracncaracncar

SEQ ID NO: 4075 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (21)..(21): a, c, g, t, unknown or other
acncarcaracncarcaracn

SEQ ID NO: 4076 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (21)..(21): a, c, g, t, unknown or other
acncarcarcaracncaracn

SEQ ID NO: 4077 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (18)..(18): a, c, g, t, unknown or other
acncarcarcaracnacncar

SEQ ID NO: 4078 - DNA, 21 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
  modified_base (21)..(21): a, c, g, t, unknown or other
acncarcarcarcaracnacn

SEQ ID NO: 4079 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
acnacncaracncarcarcar

SEQ ID NO: 4080 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
acnacncarcaracncarcar

SEQ ID NO: 4081 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (18)..(18): a, c, g, t, unknown or other
acnacncarcarcaracncar

SEQ ID NO: 4082 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (21)..(21): a, c, g, t, unknown or other
acnacncarcarcarcaracn

SEQ ID NO: 4083 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
caracnacnacncarcarcar

SEQ ID NO: 4084 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
caracnacncaracncarcar

SEQ ID NO: 4085 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (18)..(18): a, c, g, t, unknown or other
caracnacncarcaracncar

SEQ ID NO: 4086 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (21)..(21): a, c, g, t, unknown or other
caracnacncarcarcaracn

SEQ ID NO: 4087 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
caracncaracnacncarcar

SEQ ID NO: 4088 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (18)..(18): a, c, g, t, unknown or other
caracncarcaracnacncar

SEQ ID NO: 4089 - DNA, 21 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
  modified_base (21)..(21): a, c, g, t, unknown or other
caracncarcarcaracnacn

SEQ ID NO: 4090 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (18)..(18): a, c, g, t, unknown or other
caracncaracncaracncar

SEQ ID NO: 4091 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (21)..(21): a, c, g, t, unknown or other
caracncaracncarcaracn

SEQ ID NO: 4092 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (21)..(21): a, c, g, t, unknown or other
caracncarcaracncaracn

SEQ ID NO: 4093 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
carcaracnacnacncarcar

SEQ ID NO: 4094 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (18)..(18): a, c, g, t, unknown or other
carcaracnacncaracncar

SEQ ID NO: 4095 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (21)..(21): a, c, g, t, unknown or other
carcaracnacncarcaracn

SEQ ID NO: 4096 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (18)..(18): a, c, g, t, unknown or other
carcaracncaracnacncar

SEQ ID NO: 4097 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (21)..(21): a, c, g, t, unknown or other
carcaracncaracncaracn

SEQ ID NO: 4098 - DNA, 21 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
  modified_base (21)..(21): a, c, g, t, unknown or other
carcaracncarcaracnacn

SEQ ID NO: 4099 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (18)..(18): a, c, g, t, unknown or other
carcarcaracnacnacncar

SEQ ID NO: 4100 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (21)..(21): a, c, g, t, unknown or other
carcarcaracnacncaracn

SEQ ID NO: 4101 - DNA, 21 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
  modified_base (21)..(21): a, c, g, t, unknown or other
carcarcaracncaracnacn

SEQ ID NO: 4102 - DNA, 21 bp, Artificial Sequence
  Description of Artificial Sequence: Synthetic oligonucleotide
  modified_base (18)..(18): a, c, g, t, unknown or other
  modified_base (21)..(21): a, c, g, t, unknown or other
carcarcarcarcaracnacn

SEQ ID NO: 4103 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
acnacncarcarcarcarcar

SEQ ID NO: 4104 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
acncaracncarcarcarcar

SEQ ID NO: 4105 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
acncarcaracncarcarcar

SEQ ID NO: 4106 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
acncarcarcaracncarcar

SEQ ID NO: 4107 - DNA, 21 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
acncarcarcarcaracncar

SEQ ID NO: 4108 - DNA, 21 bp, Artificial Sequence
  Description of Artificial Sequence: Synthetic oligonucleotide
  modified_base (3)..(3): a, c, g, t, unknown or other
  modified_base (21)..(21): a, c, g, t, unknown or other
acncarcarcarcarcaracn

SEQ ID NO: 4109 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
caracnacncarcarcarcar

SEQ ID NO: 4110 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
caracncaracncarcarcar

SEQ ID NO: 4111 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
caracncarcaracncarcar

SEQ ID NO: 4112 - DNA, 21 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
caracncarcarcaracncar

SEQ ID NO: 4113 - DNA, 21 bp, Artificial Sequence
  Description of Artificial Sequence: Synthetic oligonucleotide
  modified_base (6)..(6): a, c, g, t, unknown or other
  modified_base (21)..(21): a, c, g, t, unknown or other
caracncarcarcarcaracn

SEQ ID NO: 4114 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
carcaracnacncarcarcar

SEQ ID NO: 4115 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
carcaracncaracncarcar

SEQ ID NO: 4116 - DNA, 21 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
carcaracncarcaracncar

SEQ ID NO: 4117 - DNA, 21 bp, Artificial Sequence
  Description of Artificial Sequence: Synthetic oligonucleotide
  modified_base (9)..(9): a, c, g, t, unknown or other
  modified_base (21)..(21): a, c, g, t, unknown or other
carcaracncarcarcaracn

SEQ ID NO: 4118 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
carcarcaracnacncarcar

SEQ ID NO: 4119 - DNA, 21 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
carcarcaracncaracncar

SEQ ID NO: 4120 - DNA, 21 bp, Artificial Sequence
  Description of Artificial Sequence: Synthetic oligonucleotide
  modified_base (12)..(12): a, c, g, t, unknown or other
  modified_base (21)..(21): a, c, g, t, unknown or other
carcarcaracncarcaracn

SEQ ID NO: 4121 - DNA, 21 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
carcarcarcaracnacncar

SEQ ID NO: 4122 - DNA, 21 bp, Artificial Sequence
  Description of Artificial Sequence: Synthetic oligonucleotide
  modified_base (15)..(15): a, c, g, t, unknown or other
  modified_base (21)..(21): a, c, g, t, unknown or other
carcarcarcaracncaracn

SEQ ID NO: 4123 - DNA, 21 bp, Artificial Sequence
  Description of Artificial Sequence: Synthetic oligonucleotide
  modified_base (21)..(21): a, c, g, t, unknown or other
carcarcarcarcarcaracn

SEQ ID NO: 4124 - DNA, 21 bp, Artificial Sequence
  Description of Artificial Sequence: Synthetic oligonucleotide
  modified_base (3)..(3): a, c, g, t, unknown or other
acncarcarcarcarcarcar

SEQ ID NO: 4125 - DNA, 21 bp, Artificial Sequence
  Description of Artificial Sequence: Synthetic oligonucleotide
  modified_base (6)..(6): a, c, g, t, unknown or other
caracncarcarcarcarcar

SEQ ID NO: 4126 - DNA, 21 bp, Artificial Sequence
  Description of Artificial Sequence: Synthetic oligonucleotide
  modified_base (9)..(9): a, c, g, t, unknown or other
carcaracncarcarcarcar

SEQ ID NO: 4127 - DNA, 21 bp, Artificial Sequence
  Description of Artificial Sequence: Synthetic oligonucleotide
  modified_base (12)..(12): a, c, g, t, unknown or other
carcarcaracncarcarcar

SEQ ID NO: 4128 - DNA, 21 bp, Artificial Sequence
  Description of Artificial Sequence: Synthetic oligonucleotide
  modified_base (15)..(15): a, c, g, t, unknown or other
carcarcarcaracncarcar

SEQ ID NO: 4129 - DNA, 21 bp, Artificial Sequence
  Description of Artificial Sequence: Synthetic oligonucleotide
  modified_base (18)..(18): a, c, g, t, unknown or other
carcarcarcarcaracncar

SEQ ID NO: 4130 - DNA, 12 bp, Artificial Sequence
  Description of Artificial Sequence: Synthetic oligonucleotide
  modified_base (12)..(12): a, c, g, t, unknown or other
carcarcargcn

SEQ ID NO: 4131 - DNA, 12 bp, Artificial Sequence
  Description of Artificial Sequence: Synthetic oligonucleotide
  modified_base (3)..(3): a, c, g, t, unknown or other
gcncarcarcar

SEQ ID NO: 4132 - DNA, 12 bp, Artificial Sequence
  Description of Artificial Sequence: Synthetic oligonucleotide
  modified_base (6)..(6): a, c, g, t, unknown or other
cargcncarcar

SEQ ID NO: 4133 - DNA, 12 bp, Artificial Sequence
  Description of Artificial Sequence: Synthetic oligonucleotide
  modified_base (9)..(9): a, c, g, t, unknown or other
carcargcncar

SEQ ID NO: 4134 - DNA, 15 bp, Artificial Sequence
  Description of Artificial Sequence: Synthetic oligonucleotide
  modified_base (15)..(15): a, c, g, t, unknown or other
carcarcarcargcn

SEQ ID NO: 4135 - DNA, 15 bp, Artificial Sequence
  Description of Artificial Sequence: Synthetic oligonucleotide
  modified_base (3)..(3): a, c, g, t, unknown or other
gcncarcarcarcar

SEQ ID NO: 4136 - DNA, 15 bp, Artificial Sequence
  Description of Artificial Sequence: Synthetic oligonucleotide
  modified_base (6)..(6): a, c, g, t, unknown or other
cargcncarcarcar

SEQ ID NO: 4137 - DNA, 15 bp, Artificial Sequence
  Description of Artificial Sequence: Synthetic oligonucleotide
  modified_base (9)..(9): a, c, g, t, unknown or other
carcargcncarcar

SEQ ID NO: 4138 - DNA, 15 bp, Artificial Sequence
  Description of Artificial Sequence: Synthetic oligonucleotide
  modified_base (12)..(12): a, c, g, t, unknown or other
carcarcargcncar

SEQ ID NO: 4139 - DNA, 15 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
carcarcargcngcn

SEQ ID NO: 4140 - DNA, 15 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
gcngcncarcarcar

SEQ ID NO: 4141 - DNA, 15 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
gcncargcncarcar

SEQ ID NO: 4142 - DNA, 15 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
gcncarcargcncar

SEQ ID NO: 4143 - DNA, 15 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
gcncarcarcargcn

SEQ ID NO: 4144 - DNA, 15 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
cargcngcncarcar

SEQ ID NO: 4145 - DNA, 15 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
cargcncargcncar

SEQ ID NO: 4146 - DNA, 15 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
cargcncarcargcn

SEQ ID NO: 4147 - DNA, 15 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
carcargcngcncar

SEQ ID NO: 4148 - DNA, 15 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
carcargcncargcn

SEQ ID NO: 4149 - DNA, 18 bp, Artificial Sequence
  Description of Artificial Sequence: Synthetic oligonucleotide
  modified_base (18)..(18): a, c, g, t, unknown or other
carcarcarcarcargcn

SEQ ID NO: 4150 - DNA, 18 bp, Artificial Sequence
  Description of Artificial Sequence: Synthetic oligonucleotide
  modified_base (3)..(3): a, c, g, t, unknown or other
gcncarcarcarcarcar

SEQ ID NO: 4151 - DNA, 18 bp, Artificial Sequence
  Description of Artificial Sequence: Synthetic oligonucleotide
  modified_base (6)..(6): a, c, g, t, unknown or other
cargcncarcarcarcar

SEQ ID NO: 4152 - DNA, 18 bp, Artificial Sequence
  Description of Artificial Sequence: Synthetic oligonucleotide
  modified_base (9)..(9): a, c, g, t, unknown or other
carcargcncarcarcar

SEQ ID NO: 4153 - DNA, 18 bp, Artificial Sequence
  Description of Artificial Sequence: Synthetic oligonucleotide
  modified_base (12)..(12): a, c, g, t, unknown or other
carcarcargcncarcar

SEQ ID NO: 4154 - DNA, 18 bp, Artificial Sequence
  Description of Artificial Sequence: Synthetic oligonucleotide
  modified_base (15)..(15): a, c, g, t, unknown or other
carcarcarcargcncar

SEQ ID NO: 4155 - DNA, 18 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
carcarcarcargcngcn

SEQ ID NO: 4156 - DNA, 18 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
gcngcncarcarcarcar

SEQ ID NO: 4157 - DNA, 18 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
gcncargcncarcarcar

SEQ ID NO: 4158 - DNA, 18 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
gcncarcargcncarcar

SEQ ID NO: 4159 - DNA, 18 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
gcncarcarcargcncar

SEQ ID NO: 4160 - DNA, 18 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
gcncarcarcarcargcn

SEQ ID NO: 4161 - DNA, 18 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
cargcngcncarcarcar

SEQ ID NO: 4162 - DNA, 18 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
cargcncargcncarcar

SEQ ID NO: 4163 - DNA, 18 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
cargcncarcargcncar

SEQ ID NO: 4164 - DNA, 18 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
cargcncarcarcargcn

SEQ ID NO: 4165 - DNA, 18 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
carcargcngcncarcar

SEQ ID NO: 4166 - DNA, 18 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
carcargcncargcncar

SEQ ID NO: 4167 - DNA, 18 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
carcargcncarcargcn

SEQ ID NO: 4168 - DNA, 18 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
carcarcargcngcncar

SEQ ID NO: 4169 - DNA, 18 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
carcarcargcncargcn

SEQ ID NO: 4170 - DNA, 21 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
  modified_base (21)..(21): a, c, g, t, unknown or other
carcarcarcargcngcngcn

SEQ ID NO: 4171 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (9)..(9): a, c, g, t, unknown or other
gcngcngcncarcarcarcar

SEQ ID NO: 4172 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (12)..(12): a, c, g, t, unknown or other
gcncargcngcncarcarcar

SEQ ID NO: 4173 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (15)..(15): a, c, g, t, unknown or other
gcncargcncargcncarcar

SEQ ID NO: 4174 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (18)..(18): a, c, g, t, unknown or other
gcncargcncarcargcncar

SEQ ID NO: 4175 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
  modified_base (21)..(21): a, c, g, t, unknown or other
gcncargcncarcarcargcn

SEQ ID NO: 4176 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (15)..(15): a, c, g, t, unknown or other
gcncarcargcngcncarcar

SEQ ID NO: 4177 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (18)..(18): a, c, g, t, unknown or other
gcncarcargcncargcncar

SEQ ID NO: 4178 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
  modified_base (21)..(21): a, c, g, t, unknown or other
gcncarcargcncarcargcn

SEQ ID NO: 4179 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (21)..(21): a, c, g, t, unknown or other
gcncarcarcargcncargcn

SEQ ID NO: 4180 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
  modified_base (18)..(18): a, c, g, t, unknown or other
gcncarcarcargcngcncar

SEQ ID NO: 4181 - DNA, 21 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
  modified_base (21)..(21): a, c, g, t, unknown or other
gcncarcarcarcargcngcn

SEQ ID NO: 4182 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (12)..(12): a, c, g, t, unknown or other
gcngcncargcncarcarcar

SEQ ID NO: 4183 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (15)..(15): a, c, g, t, unknown or other
gcngcncarcargcncarcar

SEQ ID NO: 4184 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (18)..(18): a, c, g, t, unknown or other
gcngcncarcarcargcncar

SEQ ID NO: 4185 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
  modified_base (21)..(21): a, c, g, t, unknown or other
gcngcncarcarcarcargcn

SEQ ID NO: 4186 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (12)..(12): a, c, g, t, unknown or other
cargcngcngcncarcarcar

SEQ ID NO: 4187 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (15)..(15): a, c, g, t, unknown or other
cargcngcncargcncarcar

SEQ ID NO: 4188 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (18)..(18): a, c, g, t, unknown or other
cargcngcncarcargcncar

SEQ ID NO: 4189 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
  modified_base (21)..(21): a, c, g, t, unknown or other
cargcngcncarcarcargcn

SEQ ID NO: 4190 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (15)..(15): a, c, g, t, unknown or other
cargcncargcngcncarcar

SEQ ID NO: 4191 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (18)..(18): a, c, g, t, unknown or other
cargcncarcargcngcncar

SEQ ID NO: 4192 - DNA, 21 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
  modified_base (21)..(21): a, c, g, t, unknown or other
cargcncarcarcargcngcn

SEQ ID NO: 4193 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (18)..(18): a, c, g, t, unknown or other
cargcncargcncargcncar

SEQ ID NO: 4194 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
  modified_base (21)..(21): a, c, g, t, unknown or other
cargcncargcncarcargcn

SEQ ID NO: 4195 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
  modified_base (21)..(21): a, c, g, t, unknown or other
cargcncarcargcncargcn

SEQ ID NO: 4196 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (15)..(15): a, c, g, t, unknown or other
carcargcngcngcncarcar

SEQ ID NO: 4197 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (18)..(18): a, c, g, t, unknown or other
carcargcngcncargcncar

SEQ ID NO: 4198 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
  modified_base (21)..(21): a, c, g, t, unknown or other
carcargcngcncarcargcn

SEQ ID NO: 4199 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (18)..(18): a, c, g, t, unknown or other
carcargcncargcngcncar

SEQ ID NO: 4200 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
  modified_base (21)..(21): a, c, g, t, unknown or other
carcargcncargcncargcn

SEQ ID NO: 4201 - DNA, 21 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
  modified_base (21)..(21): a, c, g, t, unknown or other
carcargcncarcargcngcn

SEQ ID NO: 4202 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (18)..(18): a, c, g, t, unknown or other
carcarcargcngcngcncar

SEQ ID NO: 4203 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
  modified_base (21)..(21): a, c, g, t, unknown or other
carcarcargcngcncargcn

SEQ ID NO: 4204 - DNA, 21 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
  modified_base (21)..(21): a, c, g, t, unknown or other
carcarcargcncargcngcn

SEQ ID NO: 4205 - DNA, 21 bp, Artificial Sequence
  Description of Artificial Sequence: Synthetic oligonucleotide
  modified_base (18)..(18): a, c, g, t, unknown or other
  modified_base (21)..(21): a, c, g, t, unknown or other
carcarcarcarcargcngcn

SEQ ID NO: 4206 - DNA, 21 bp, Artificial Sequence
  Description of Artificial Sequence: Synthetic oligonucleotide
  modified_base (3)..(3): a, c, g, t, unknown or other
  modified_base (6)..(6): a, c, g, t, unknown or other
gcngcncarcarcarcarcar

SEQ ID NO: 4207 - DNA, 21 bp, Artificial Sequence
  Description of Artificial Sequence: Synthetic oligonucleotide
  modified_base (3)..(3): a, c, g, t, unknown or other
  modified_base (9)..(9): a, c, g, t, unknown or other
gcncargcncarcarcarcar

SEQ ID NO: 4208 - DNA, 21 bp, Artificial Sequence
  Description of Artificial Sequence: Synthetic oligonucleotide
  modified_base (3)..(3): a, c, g, t, unknown or other
  modified_base (12)..(12): a, c, g, t, unknown or other
gcncarcargcncarcarcar

SEQ ID NO: 4209 - DNA, 21 bp, Artificial Sequence
  Description of Artificial Sequence: Synthetic oligonucleotide
  modified_base (3)..(3): a, c, g, t, unknown or other
  modified_base (15)..(15): a, c, g, t, unknown or other
gcncarcarcargcncarcar

SEQ ID NO: 4210 - DNA, 21 bp, Artificial Sequence
  Description of Artificial Sequence: Synthetic oligonucleotide
  modified_base (3)..(3): a, c, g, t, unknown or other
  modified_base (18)..(18): a, c, g, t, unknown or other
gcncarcarcarcargcncar

SEQ ID NO: 4211 - DNA, 21 bp, Artificial Sequence
  Description of Artificial Sequence: Synthetic oligonucleotide
  modified_base (3)..(3): a, c, g, t, unknown or other
  modified_base (21)..(21): a, c, g, t, unknown or other
gcncarcarcarcarcargcn

SEQ ID NO: 4212 - DNA, 21 bp, Artificial Sequence
  Description of Artificial Sequence: Synthetic oligonucleotide
  modified_base (6)..(6): a, c, g, t, unknown or other
  modified_base (9)..(9): a, c, g, t, unknown or other
cargcngcncarcarcarcar

SEQ ID NO: 4213 - DNA, 21 bp, Artificial Sequence
  Description of Artificial Sequence: Synthetic oligonucleotide
  modified_base (6)..(6): a, c, g, t, unknown or other
  modified_base (12)..(12): a, c, g, t, unknown or other
cargcncargcncarcarcar

SEQ ID NO: 4214 - DNA, 21 bp, Artificial Sequence
  Description of Artificial Sequence: Synthetic oligonucleotide
  modified_base (6)..(6): a, c, g, t, unknown or other
  modified_base (15)..(15): a, c, g, t, unknown or other
cargcncarcargcncarcar

SEQ ID NO: 4215 - DNA, 21 bp, Artificial Sequence
  Description of Artificial Sequence: Synthetic oligonucleotide
  modified_base (6)..(6): a, c, g, t, unknown or other
  modified_base (18)..(18): a, c, g, t, unknown or other
cargcncarcarcargcncar

SEQ ID NO: 4216 - DNA, 21 bp, Artificial Sequence
  Description of Artificial Sequence: Synthetic oligonucleotide
  modified_base (6)..(6): a, c, g, t, unknown or other
  modified_base (21)..(21): a, c, g, t, unknown or other
cargcncarcarcarcargcn

SEQ ID NO: 4217 - DNA, 21 bp, Artificial Sequence
  Description of Artificial Sequence: Synthetic oligonucleotide
  modified_base (9)..(9): a, c, g, t, unknown or other
  modified_base (12)..(12): a, c, g, t, unknown or other
carcargcngcncarcarcar

SEQ ID NO: 4218 - DNA, 21 bp, Artificial Sequence
  Description of Artificial Sequence: Synthetic oligonucleotide
  modified_base (9)..(9): a, c, g, t, unknown or other
  modified_base (15)..(15): a, c, g, t, unknown or other
carcargcncargcncarcar

SEQ ID NO: 4219 - DNA, 21 bp, Artificial Sequence
  Description of Artificial Sequence: Synthetic oligonucleotide
  modified_base (9)..(9): a, c, g, t, unknown or other
  modified_base (18)..(18): a, c, g, t, unknown or other
carcargcncarcargcncar

SEQ ID NO: 4220 - DNA, 21 bp, Artificial Sequence
  Description of Artificial Sequence: Synthetic oligonucleotide
  modified_base (9)..(9): a, c, g, t, unknown or other
  modified_base (21)..(21): a, c, g, t, unknown or other
carcargcncarcarcargcn

SEQ ID NO: 4221 - DNA, 21 bp, Artificial Sequence
  Description of Artificial Sequence: Synthetic oligonucleotide
  modified_base (12)..(12): a, c, g, t, unknown or other
  modified_base (15)..(15): a, c, g, t, unknown or other
carcarcargcngcncarcar

SEQ ID NO: 4222 - DNA, 21 bp, Artificial Sequence
  Description of Artificial Sequence: Synthetic oligonucleotide
  modified_base (12)..(12): a, c, g, t, unknown or other
  modified_base (18)..(18): a, c, g, t, unknown or other
carcarcargcncargcncar

SEQ ID NO: 4223 - DNA, 21 bp, Artificial Sequence
  Description of Artificial Sequence: Synthetic oligonucleotide
  modified_base (12)..(12): a, c, g, t, unknown or other
  modified_base (21)..(21): a, c, g, t, unknown or other
carcarcargcncarcargcn

SEQ ID NO: 4224 - DNA, 21 bp, Artificial Sequence
  Description of Artificial Sequence: Synthetic oligonucleotide
  modified_base (15)..(15): a, c, g, t, unknown or other
  modified_base (18)..(18): a, c, g, t, unknown or other
carcarcarcargcngcncar

SEQ ID NO: 4225 - DNA, 21 bp, Artificial Sequence
  Description of Artificial Sequence: Synthetic oligonucleotide
  modified_base (15)..(15): a, c, g, t, unknown or other
  modified_base (21)..(21): a, c, g, t, unknown or other
carcarcarcargcncargcn

SEQ ID NO: 4226 - DNA, 21 bp, Artificial Sequence
  Description of Artificial Sequence: Synthetic oligonucleotide
  modified_base (21)..(21): a, c, g, t, unknown or other
carcarcarcarcarcargcn

SEQ ID NO: 4227 - DNA, 21 bp, Artificial Sequence
  Description of Artificial Sequence: Synthetic oligonucleotide
  modified_base (3)..(3): a, c, g, t, unknown or other
gcncarcarcarcarcarcar

SEQ ID NO: 4228 - DNA, 21 bp, Artificial Sequence
  Description of Artificial Sequence: Synthetic oligonucleotide
  modified_base (6)..(6): a, c, g, t, unknown or other
cargcncarcarcarcarcar

SEQ ID NO: 4229 - DNA, 21 bp, Artificial Sequence
  Description of Artificial Sequence: Synthetic oligonucleotide
  modified_base (9)..(9): a, c, g, t, unknown or other
carcargcncarcarcarcar

SEQ ID NO: 4230 - DNA, 21 bp, Artificial Sequence
  Description of Artificial Sequence: Synthetic oligonucleotide
  modified_base (12)..(12): a, c, g, t, unknown or other
carcarcargcncarcarcar

SEQ ID NO: 4231 - DNA, 21 bp, Artificial Sequence
  Description of Artificial Sequence: Synthetic oligonucleotide
  modified_base (15)..(15): a, c, g, t, unknown or other
carcarcarcargcncarcar

SEQ ID NO: 4232 - DNA, 21 bp, Artificial Sequence
  Description of Artificial Sequence: Synthetic oligonucleotide
  modified_base (18)..(18): a, c, g, t, unknown or other
carcarcarcarcargcncar

SEQ ID NO: 4233 - DNA, 12 bp, Artificial Sequence
  Description of Artificial Sequence: Synthetic oligonucleotide
carcarcaragy

SEQ ID NO: 4234 - DNA, 12 bp, Artificial Sequence
  Description of Artificial Sequence: Synthetic oligonucleotide
agycarcarcar

SEQ ID NO: 4235 - DNA, 12 bp, Artificial Sequence
  Description of Artificial Sequence: Synthetic oligonucleotide
caragycarcar

SEQ ID NO: 4236 - DNA, 12 bp, Artificial Sequence
  Description of Artificial Sequence: Synthetic oligonucleotide
carcaragycar

SEQ ID NO: 4237 - DNA, 15 bp, Artificial Sequence
  Description of Artificial Sequence: Synthetic oligonucleotide
carcarcarcaragy

SEQ ID NO: 4238 - DNA, 15 bp, Artificial Sequence
  Description of Artificial Sequence: Synthetic oligonucleotide
agycarcarcarcar

SEQ ID NO: 4239 - DNA, 15 bp, Artificial Sequence
  Description of Artificial Sequence: Synthetic oligonucleotide
caragycarcarcar

SEQ ID NO: 4240 - DNA, 15 bp, Artificial Sequence
  Description of Artificial Sequence: Synthetic oligonucleotide
carcaragycarcar

SEQ ID NO: 4241 - DNA, 15 bp, Artificial Sequence
  Description of Artificial Sequence: Synthetic oligonucleotide
carcarcaragycar

SEQ ID NO: 4242 - DNA, 15 bp, Artificial Sequence
  Description of Artificial Sequence: Synthetic oligonucleotide
carcarcaragyagy

SEQ ID NO: 4243 - DNA, 15 bp, Artificial Sequence
  Description of Artificial Sequence: Synthetic oligonucleotide
agyagycarcarcar

SEQ ID NO: 4244 - DNA, 15 bp, Artificial Sequence
  Description of Artificial Sequence: Synthetic oligonucleotide
agycaragycarcar

SEQ ID NO: 4245 - DNA, 15 bp, Artificial Sequence
  Description of Artificial Sequence: Synthetic oligonucleotide
agycarcaragycar

SEQ ID NO: 4246 - DNA, 15 bp, Artificial Sequence
  Description of Artificial Sequence: Synthetic oligonucleotide
agycarcarcaragy

SEQ ID NO: 4247 - DNA, 15 bp, Artificial Sequence
  Description of Artificial Sequence: Synthetic oligonucleotide
caragyagycarcar

SEQ ID NO: 4248 - DNA, 15 bp, Artificial Sequence
  Description of Artificial Sequence: Synthetic oligonucleotide
caragycaragycar

SEQ ID NO: 4249 - DNA, 15 bp, Artificial Sequence
  Description of Artificial Sequence: Synthetic oligonucleotide
caragycarcaragy

SEQ ID NO: 4250 - DNA, 15 bp, Artificial Sequence
  Description of Artificial Sequence: Synthetic oligonucleotide
carcaragyagycar

SEQ ID NO: 4251 - DNA, 15 bp, Artificial Sequence
  Description of Artificial Sequence: Synthetic oligonucleotide
carcaragycaragy

SEQ ID NO: 4252 - DNA, 18 bp, Artificial Sequence
  Description of Artificial Sequence: Synthetic oligonucleotide
carcarcarcarcaragy

SEQ ID NO: 4253 - DNA, 18 bp, Artificial Sequence
  Description of Artificial Sequence: Synthetic oligonucleotide
agycarcarcarcarcar

SEQ ID NO: 4254 - DNA, 18 bp, Artificial Sequence
  Description of Artificial Sequence: Synthetic oligonucleotide
caragycarcarcarcar

SEQ ID NO: 4255 - DNA, 18 bp, Artificial Sequence
  Description of Artificial Sequence: Synthetic oligonucleotide
carcaragycarcarcar

SEQ ID NO: 4256 - DNA, 18 bp, Artificial Sequence
  Description of Artificial Sequence: Synthetic oligonucleotide
carcarcaragycarcar

SEQ ID NO: 4257 - DNA, 18 bp, Artificial Sequence
  Description of Artificial Sequence: Synthetic oligonucleotide
carcarcarcaragycar

SEQ ID NO: 4258 - DNA, 18 bp, Artificial Sequence
  Description of Artificial Sequence: Synthetic oligonucleotide
carcarcarcaragyagy

SEQ ID NO: 4259 - DNA, 18 bp, Artificial Sequence
  Description of Artificial Sequence: Synthetic oligonucleotide
agyagycarcarcarcar

SEQ ID NO: 4260 - DNA, 18 bp, Artificial Sequence
  Description of Artificial Sequence: Synthetic oligonucleotide
agycaragycarcarcar

SEQ ID NO: 4261 - DNA, 18 bp, Artificial Sequence
  Description of Artificial Sequence: Synthetic oligonucleotide
agycarcaragycarcar

SEQ ID NO: 4262 - DNA, 18 bp, Artificial Sequence
  Description of Artificial Sequence: Synthetic oligonucleotide
agycarcarcaragycar

SEQ ID NO: 4263 - DNA, 18 bp, Artificial Sequence
  Description of Artificial Sequence: Synthetic oligonucleotide
agycarcarcarcaragy

SEQ ID NO: 4264 - DNA, 18 bp, Artificial Sequence
  Description of Artificial Sequence: Synthetic oligonucleotide
caragyagycarcarcar

SEQ ID NO: 4265 - DNA, 18 bp, Artificial Sequence
  Description of Artificial Sequence: Synthetic oligonucleotide
caragycaragycarcar

SEQ ID NO: 4266 - DNA, 18 bp, Artificial Sequence
  Description of Artificial Sequence: Synthetic oligonucleotide
caragycarcaragycar

SEQ ID NO: 4267 - DNA, 18 bp, Artificial Sequence
  Description of Artificial Sequence: Synthetic oligonucleotide
caragycarcarcaragy

SEQ ID NO: 4268 - DNA, 18 bp, Artificial Sequence
  Description of Artificial Sequence: Synthetic oligonucleotide
carcaragyagycarcar

SEQ ID NO: 4269 - DNA, 18 bp, Artificial Sequence
  Description of Artificial Sequence: Synthetic oligonucleotide
carcaragycaragycar

SEQ ID NO: 4270 - DNA, 18 bp, Artificial Sequence
  Description of Artificial Sequence: Synthetic oligonucleotide
carcaragycarcaragy

SEQ ID NO: 4271 - DNA, 18 bp, Artificial Sequence
  Description of Artificial Sequence: Synthetic oligonucleotide
carcarcaragyagycar

SEQ ID NO: 4272 - DNA, 18 bp, Artificial Sequence
  Description of Artificial Sequence: Synthetic oligonucleotide
carcarcaragycaragy

SEQ ID NO: 4273 - DNA, 21 bp, Artificial Sequence
  Description of Artificial Sequence: Synthetic oligonucleotide
carcarcarcaragyagyagy

SEQ ID NO: 4274 - DNA, 21 bp, Artificial Sequence
  Description of Artificial Sequence: Synthetic oligonucleotide
agyagyagycarcarcarcar

SEQ ID NO: 4275 - DNA, 21 bp, Artificial Sequence
  Description of Artificial Sequence: Synthetic oligonucleotide
agycaragyagycarcarcar

SEQ ID NO: 4276 - DNA, 21 bp, Artificial Sequence
  Description of Artificial Sequence: Synthetic oligonucleotide
agycaragycaragycarcar

SEQ ID NO: 4277 - DNA, 21 bp, Artificial Sequence
  Description of Artificial Sequence: Synthetic oligonucleotide
agycaragycarcaragycar

SEQ ID NO: 4278 - DNA, 21 bp, Artificial Sequence
  Description of Artificial Sequence: Synthetic oligonucleotide
agycaragycarcarcaragy

SEQ ID NO: 4279 - DNA, 21 bp, Artificial Sequence
  Description of Artificial Sequence: Synthetic oligonucleotide
agycarcaragyagycarcar

SEQ ID NO: 4280 - DNA, 21 bp, Artificial Sequence
  Description of Artificial Sequence: Synthetic oligonucleotide
agycarcaragycaragycar

SEQ ID NO: 4281 - DNA, 21 bp, Artificial Sequence
  Description of Artificial Sequence: Synthetic oligonucleotide
agycarcaragycarcaragy

SEQ ID NO: 4282 - DNA, 21 bp, Artificial Sequence
  Description of Artificial Sequence: Synthetic oligonucleotide
agycarcarcaragycaragy

SEQ ID NO: 4283 - DNA, 21 bp, Artificial Sequence
  Description of Artificial Sequence: Synthetic oligonucleotide
agycarcarcaragyagycar

SEQ ID NO: 4284 - DNA, 21 bp, Artificial Sequence
  Description of Artificial Sequence: Synthetic oligonucleotide
agycarcarcarcaragyagy

SEQ ID NO: 4285 - DNA, 21 bp, Artificial Sequence
  Description of Artificial Sequence: Synthetic oligonucleotide
agyagycaragycarcarcar

SEQ ID NO: 4286 - DNA, 21 bp, Artificial Sequence
  Description of Artificial Sequence: Synthetic oligonucleotide
agyagycarcaragycarcar

SEQ ID NO: 4287 - DNA, 21 bp, Artificial Sequence
  Description of Artificial Sequence: Synthetic oligonucleotide
agyagycarcarcaragycar

SEQ ID NO: 4288 - DNA, 21 bp, Artificial Sequence
  Description of Artificial Sequence: Synthetic oligonucleotide
agyagycarcarcarcaragy

SEQ ID NO: 4289 - DNA, 21 bp, Artificial Sequence
  Description of Artificial Sequence: Synthetic oligonucleotide
caragyagyagycarcarcar

SEQ ID NO: 4290 - DNA, 21 bp, Artificial Sequence
  Description of Artificial Sequence: Synthetic oligonucleotide
caragyagycaragycarcar

SEQ ID NO: 4291 - DNA, 21 bp, Artificial Sequence
  Description of Artificial Sequence: Synthetic oligonucleotide
caragyagycarcaragycar

SEQ ID NO: 4292 - DNA, 21 bp, Artificial Sequence
  Description of Artificial Sequence: Synthetic oligonucleotide
caragyagycarcarcaragy

SEQ ID NO: 4293 - DNA, 21 bp, Artificial Sequence
  Description of Artificial Sequence: Synthetic oligonucleotide
caragycaragyagycarcar

SEQ ID NO: 4294 - DNA, 21 bp, Artificial Sequence
  Description of Artificial Sequence: Synthetic oligonucleotide
caragycarcaragyagycar

SEQ ID NO: 4295 - DNA, 21 bp, Artificial Sequence
  Description of Artificial Sequence: Synthetic oligonucleotide
caragycarcarcaragyagy

SEQ ID NO: 4296 - DNA, 21 bp, Artificial Sequence
  Description of Artificial Sequence: Synthetic oligonucleotide
caragycaragycaragycar

SEQ ID NO: 4297 - DNA, 21 bp, Artificial Sequence
  Description of Artificial Sequence: Synthetic oligonucleotide
caragycaragycarcaragy

SEQ ID NO: 4298 - DNA, 21 bp, Artificial Sequence
  Description of Artificial Sequence: Synthetic oligonucleotide
caragycarcaragycaragy

SEQ ID NO: 4299 - DNA, 21 bp, Artificial Sequence
  Description of Artificial Sequence: Synthetic oligonucleotide
carcaragyagyagycarcar

SEQ ID NO: 4300 - DNA, 21 bp, Artificial Sequence
  Description of Artificial Sequence: Synthetic oligonucleotide
carcaragyagycaragycar

SEQ ID NO: 4301 - DNA, 21 bp, Artificial Sequence
  Description of Artificial Sequence: Synthetic oligonucleotide
carcaragyagycarcaragy

SEQ ID NO: 4302 - DNA, 21 bp, Artificial Sequence
  Description of Artificial Sequence: Synthetic oligonucleotide
carcaragycaragyagycar

SEQ ID NO: 4303 - DNA, 21 bp, Artificial Sequence
  Description of Artificial Sequence: Synthetic oligonucleotide
carcaragycaragycaragy

SEQ ID NO: 4304 - DNA, 21 bp, Artificial Sequence
  Description of Artificial Sequence: Synthetic oligonucleotide
carcaragycarcaragyagy

SEQ ID NO: 4305 - DNA, 21 bp, Artificial Sequence
  Description of Artificial Sequence: Synthetic oligonucleotide
carcarcaragyagyagycar

SEQ ID NO: 4306 - DNA, 21 bp, Artificial Sequence
  Description of Artificial Sequence: Synthetic oligonucleotide
carcarcaragyagycaragy

SEQ ID NO: 4307 - DNA, 21 bp, Artificial Sequence
  Description of Artificial Sequence: Synthetic oligonucleotide
carcarcaragycaragyagy

SEQ ID NO: 4308 - DNA, 21 bp, Artificial Sequence
  Description of Artificial Sequence: Synthetic oligonucleotide
carcarcarcarcaragyagy

SEQ ID NO: 4309 - DNA, 21 bp, Artificial Sequence
  Description of Artificial Sequence: Synthetic oligonucleotide
agyagycarcarcarcarcar

SEQ ID NO: 4310 - DNA, 21 bp, Artificial Sequence
  Description of Artificial Sequence: Synthetic oligonucleotide
agycaragycarcarcarcar

SEQ ID NO: 4311 - DNA, 21 bp, Artificial Sequence
  Description of Artificial Sequence: Synthetic oligonucleotide
agycarcaragycarcarcar

SEQ ID NO: 4312 - DNA, 21 bp, Artificial Sequence
  Description of Artificial Sequence: Synthetic oligonucleotide
agycarcarcaragycarcar

SEQ ID NO: 4313 - DNA, 21 bp, Artificial Sequence
  Description of Artificial Sequence: Synthetic oligonucleotide
agycarcarcarcaragycar

SEQ ID NO: 4314 - DNA, 21 bp, Artificial Sequence
  Description of Artificial Sequence: Synthetic oligonucleotide
agycarcarcarcarcaragy

SEQ ID NO: 4315 - DNA, 21 bp, Artificial Sequence
  Description of Artificial Sequence: Synthetic oligonucleotide
caragyagycarcarcarcar

SEQ ID NO: 4316 - DNA, 21 bp, Artificial Sequence
  Description of Artificial Sequence: Synthetic oligonucleotide
caragycaragycarcarcar

SEQ ID NO: 4317 - DNA, 21 bp, Artificial Sequence
  Description of Artificial Sequence: Synthetic oligonucleotide
caragycarcaragycarcar

SEQ ID NO: 4318 - DNA, 21 bp, Artificial Sequence
  Description of Artificial Sequence: Synthetic oligonucleotide
caragycarcarcaragycar

SEQ ID NO: 4319 - DNA, 21 bp, Artificial Sequence
  Description of Artificial Sequence: Synthetic oligonucleotide
caragycarcarcarcaragy

SEQ ID NO: 4320 - DNA, 21 bp, Artificial Sequence
  Description of Artificial Sequence: Synthetic oligonucleotide
carcaragyagycarcarcar

SEQ ID NO: 4321 - DNA, 21 bp, Artificial Sequence
  Description of Artificial Sequence: Synthetic oligonucleotide
carcaragycaragycarcar

SEQ ID NO: 4322 - DNA, 21 bp, Artificial Sequence
  Description of Artificial Sequence: Synthetic oligonucleotide
carcaragycarcaragycar

SEQ ID NO: 4323 - DNA, 21 bp, Artificial Sequence
  Description of Artificial Sequence: Synthetic oligonucleotide
carcaragycarcarcaragy

SEQ ID NO: 4324 - DNA, 21 bp, Artificial Sequence
  Description of Artificial Sequence: Synthetic oligonucleotide
carcarcaragyagycarcar

SEQ ID NO: 4325 - DNA, 21 bp, Artificial Sequence
  Description of Artificial Sequence: Synthetic oligonucleotide
carcarcaragycaragycar

SEQ ID NO: 4326 - DNA, 21 bp, Artificial Sequence
  Description of Artificial Sequence: Synthetic oligonucleotide
carcarcaragycarcaragy

SEQ ID NO: 4327 - DNA, 21 bp, Artificial Sequence
  Description of Artificial Sequence: Synthetic oligonucleotide
carcarcarcaragyagycar

SEQ ID NO: 4328 - DNA, 21 bp, Artificial Sequence
  Description of Artificial Sequence: Synthetic oligonucleotide
carcarcarcaragycaragy

SEQ ID NO: 4329 - DNA, 21 bp, Artificial Sequence
  Description of Artificial Sequence: Synthetic oligonucleotide
carcarcarcarcarcaragy

SEQ ID NO: 4330 - DNA, 21 bp, Artificial Sequence
  Description of Artificial Sequence: Synthetic oligonucleotide
agycarcarcarcarcarcar

SEQ ID NO: 4331 - DNA, 21 bp, Artificial Sequence
  Description of Artificial Sequence: Synthetic oligonucleotide
caragycarcarcarcarcar

SEQ ID NO: 4332 - DNA, 21 bp, Artificial Sequence
  Description of Artificial Sequence: Synthetic oligonucleotide
carcaragycarcarcarcar

SEQ ID NO: 4333 - DNA, 21 bp, Artificial Sequence
  Description of Artificial Sequence: Synthetic oligonucleotide
carcarcaragycarcarcar

SEQ ID NO: 4334 - DNA, 21 bp, Artificial Sequence
  Description of Artificial Sequence: Synthetic oligonucleotide
carcarcarcaragycarcar

SEQ ID NO: 4335 - DNA, 21 bp, Artificial Sequence
  Description of Artificial Sequence: Synthetic oligonucleotide
carcarcarcarcaragycar

SEQ ID NO: 4336 - DNA, 12 bp, Artificial Sequence
  Description of Artificial Sequence: Synthetic oligonucleotide
carcarcargar

SEQ ID NO: 4337 - DNA, 12 bp, Artificial Sequence
  Description of Artificial Sequence: Synthetic oligonucleotide
garcarcarcar

SEQ ID NO: 4338 - DNA, 12 bp, Artificial Sequence
  Description of Artificial Sequence: Synthetic oligonucleotide
cargarcarcar

SEQ ID NO: 4339 - DNA, 12 bp, Artificial Sequence
  Description of Artificial Sequence: Synthetic oligonucleotide
carcargarcar

SEQ ID NO: 4340 - DNA, 15 bp, Artificial Sequence
  Description of Artificial Sequence: Synthetic oligonucleotide
carcarcarcargar

SEQ ID NO: 4341 - DNA, 15 bp, Artificial Sequence
  Description of Artificial Sequence: Synthetic oligonucleotide
garcarcarcarcar

SEQ ID NO: 4342 - DNA, 15 bp, Artificial Sequence
  Description of Artificial Sequence: Synthetic oligonucleotide
cargarcarcarcar

SEQ ID NO: 4343 - DNA, 15 bp, Artificial Sequence
  Description of Artificial Sequence: Synthetic oligonucleotide
carcargarcarcar

SEQ ID NO: 4344 - DNA, 15 bp, Artificial Sequence
  Description of Artificial Sequence: Synthetic oligonucleotide
carcarcargarcar

SEQ ID NO: 4345 - DNA, 15 bp, Artificial Sequence
  Description of Artificial Sequence: Synthetic oligonucleotide
carcarcargargar

SEQ ID NO: 4346 - DNA, 15 bp, Artificial Sequence
  Description of Artificial Sequence: Synthetic oligonucleotide
gargarcarcarcar

SEQ ID NO: 4347 - DNA, 15 bp, Artificial Sequence
  Description of Artificial Sequence: Synthetic oligonucleotide
garcargarcarcar

SEQ ID NO: 4348 - DNA, 15 bp, Artificial Sequence
  Description of Artificial Sequence: Synthetic oligonucleotide
garcarcargarcar

SEQ ID NO: 4349 - DNA, 15 bp, Artificial Sequence
  Description of Artificial Sequence: Synthetic oligonucleotide
garcarcarcargar

SEQ ID NO: 4350 - DNA, 15 bp, Artificial Sequence
  Description of Artificial Sequence: Synthetic oligonucleotide
cargargarcarcar

SEQ ID NO: 4351 - DNA, 15 bp, Artificial Sequence
  Description of Artificial Sequence: Synthetic oligonucleotide
cargarcargarcar

SEQ ID NO: 4352 - DNA, 15 bp, Artificial Sequence
  Description of Artificial Sequence: Synthetic oligonucleotide
cargarcarcargar

SEQ ID NO: 4353 - DNA, 15 bp, Artificial Sequence
  Description of Artificial Sequence: Synthetic oligonucleotide
carcargargarcar

SEQ ID NO: 4354 - DNA, 15 bp, Artificial Sequence
  Description of Artificial Sequence: Synthetic oligonucleotide
carcargarcargar

SEQ ID NO: 4355 - DNA, 18 bp, Artificial Sequence
  Description of Artificial Sequence: Synthetic oligonucleotide
carcarcarcarcargar

SEQ ID NO: 4356 - DNA, 18 bp, Artificial Sequence
  Description of Artificial Sequence: Synthetic oligonucleotide
garcarcarcarcarcar

SEQ ID NO: 4357 - DNA, 18 bp, Artificial Sequence
  Description of Artificial Sequence: Synthetic oligonucleotide
cargarcarcarcarcar

SEQ ID NO: 4358 - DNA, 18 bp, Artificial Sequence
  Description of Artificial Sequence: Synthetic oligonucleotide
carcargarcarcarcar

SEQ ID NO: 4359 - DNA, 18 bp, Artificial Sequence
  Description of Artificial Sequence: Synthetic oligonucleotide
carcarcargarcarcar

SEQ ID NO: 4360 - DNA, 18 bp, Artificial Sequence
  Description of Artificial Sequence: Synthetic oligonucleotide
carcarcarcargarcar

SEQ ID NO: 4361 - DNA, 18 bp, Artificial Sequence
  Description of Artificial Sequence: Synthetic oligonucleotide
carcarcarcargargar

SEQ ID NO: 4362 - DNA, 18 bp, Artificial Sequence
  Description of Artificial Sequence: Synthetic oligonucleotide
gargarcarcarcarcar

SEQ ID NO: 4363 - DNA, 18 bp, Artificial Sequence
  Description of Artificial Sequence: Synthetic oligonucleotide
garcargarcarcarcar

SEQ ID NO: 4364 - DNA, 18 bp, Artificial Sequence
  Description of Artificial Sequence: Synthetic oligonucleotide
garcarcargarcarcar

SEQ ID NO: 4365 - DNA, 18 bp, Artificial Sequence
  Description of Artificial Sequence: Synthetic oligonucleotide
garcarcarcargarcar

SEQ ID NO: 4366 - DNA, 18 bp, Artificial Sequence
  Description of Artificial Sequence: Synthetic oligonucleotide
garcarcarcarcargar

SEQ ID NO: 4367 - DNA, 18 bp, Artificial Sequence
  Description of Artificial Sequence: Synthetic oligonucleotide
cargargarcarcarcar

SEQ ID NO: 4368 - DNA, 18 bp, Artificial Sequence
  Description of Artificial Sequence: Synthetic oligonucleotide
cargarcargarcarcar

SEQ ID NO: 4369 - DNA, 18 bp, Artificial Sequence
  Description of Artificial Sequence: Synthetic oligonucleotide
cargarcarcargarcar

SEQ ID NO: 4370 - DNA, 18 bp, Artificial Sequence
  Description of Artificial Sequence: Synthetic oligonucleotide
cargarcarcarcargar

SEQ ID NO: 4371 - DNA, 18 bp, Artificial Sequence
  Description of Artificial Sequence: Synthetic oligonucleotide
carcargargarcarcar

SEQ ID NO: 4372 - DNA, 18 bp, Artificial Sequence
  Description of Artificial Sequence: Synthetic oligonucleotide
carcargarcargarcar

SEQ ID NO: 4373 - DNA, 18 bp, Artificial Sequence
  Description of Artificial Sequence: Synthetic oligonucleotide
carcargarcarcargar

SEQ ID NO: 4374 - DNA, 18 bp, Artificial Sequence
  Description of Artificial Sequence: Synthetic oligonucleotide
carcarcargargarcar

SEQ ID NO: 4375 - DNA, 18 bp, Artificial Sequence
  Description of Artificial Sequence: Synthetic oligonucleotide
carcarcargarcargar

SEQ ID NO: 4376 - DNA, 21 bp, Artificial Sequence
  Description of Artificial Sequence: Synthetic oligonucleotide
carcarcarcargargargar

SEQ ID NO: 4377 - DNA, 21 bp, Artificial Sequence
  Description of Artificial Sequence: Synthetic oligonucleotide
gargargarcarcarcarcar

SEQ ID NO: 4378 - DNA, 21 bp, Artificial Sequence
  Description of Artificial Sequence: Synthetic oligonucleotide
garcargargarcarcarcar

SEQ ID NO: 4379 - DNA, 21 bp, Artificial Sequence
  Description of Artificial Sequence: Synthetic oligonucleotide
garcargarcargarcarcar

SEQ ID NO: 4380 - DNA, 21 bp, Artificial Sequence
  Description of Artificial Sequence: Synthetic oligonucleotide
garcargarcarcargarcar

SEQ ID NO: 4381 - DNA, 21 bp, Artificial Sequence
  Description of Artificial Sequence: Synthetic oligonucleotide
garcargarcarcarcargar

SEQ ID NO: 4382 - DNA, 21 bp, Artificial Sequence
  Description of Artificial Sequence: Synthetic oligonucleotide
garcarcargargarcarcar

SEQ ID NO: 4383 - DNA, 21 bp, Artificial Sequence
  Description of Artificial Sequence: Synthetic oligonucleotide
garcarcargarcargarcar

SEQ ID NO: 4384 - DNA, 21 bp, Artificial Sequence
  Description of Artificial Sequence: Synthetic oligonucleotide
garcarcargarcarcargar

SEQ ID NO: 4385 - DNA, 21 bp, Artificial Sequence
  Description of Artificial Sequence: Synthetic oligonucleotide
garcarcarcargarcargar

SEQ ID NO: 4386 - DNA, 21 bp, Artificial Sequence
  Description of Artificial Sequence: Synthetic oligonucleotide
garcarcarcargargarcar

SEQ ID NO: 4387 - DNA, 21 bp, Artificial Sequence
  Description of Artificial Sequence: Synthetic oligonucleotide
garcarcarcarcargargar

SEQ ID NO: 4388 - DNA, 21 bp, Artificial Sequence
  Description of Artificial Sequence: Synthetic oligonucleotide
gargarcargarcarcarcar

SEQ ID NO: 4389 - DNA, 21 bp, Artificial Sequence
  Description of Artificial Sequence: Synthetic oligonucleotide
gargarcarcargarcarcar

SEQ ID NO: 4390 - DNA, 21 bp, Artificial Sequence
  Description of Artificial Sequence: Synthetic oligonucleotide
gargarcarcarcargarcar

SEQ ID NO: 4391 - DNA, 21 bp, Artificial Sequence
  Description of Artificial Sequence: Synthetic oligonucleotide
gargarcarcarcarcargar

SEQ ID NO: 4392 - DNA, 21 bp, Artificial Sequence
  Description of Artificial Sequence: Synthetic oligonucleotide
cargargargarcarcarcar

SEQ ID NO: 4393 - DNA, 21 bp, Artificial Sequence
  Description of Artificial Sequence: Synthetic oligonucleotide
cargargarcargarcarcar

SEQ ID NO: 4394 - DNA, 21 bp, Artificial Sequence
  Description of Artificial Sequence: Synthetic oligonucleotide
cargargarcarcargarcar

SEQ ID NO: 4395 - DNA, 21 bp, Artificial Sequence
  Description of Artificial Sequence: Synthetic oligonucleotide
cargargarcarcarcargar

SEQ ID NO: 4396 - DNA, 21 bp, Artificial Sequence
  Description of Artificial Sequence: Synthetic oligonucleotide
cargarcargargarcarcar

SEQ ID NO: 4397 - DNA, 21 bp, Artificial Sequence
  Description of Artificial Sequence: Synthetic oligonucleotide
cargarcarcargargarcar

SEQ ID NO: 4398 - DNA, 21 bp, Artificial Sequence
  Description of Artificial Sequence: Synthetic oligonucleotide
cargarcarcarcargargar

SEQ ID NO: 4399 - DNA, 21 bp, Artificial Sequence
  Description of Artificial Sequence: Synthetic oligonucleotide
cargarcargarcargarcar

SEQ ID NO: 4400 - DNA, 21 bp, Artificial Sequence
  Description of Artificial Sequence: Synthetic oligonucleotide
cargarcargarcarcargar

SEQ ID NO: 4401 - DNA, 21 bp, Artificial Sequence
  Description of Artificial Sequence: Synthetic oligonucleotide
cargarcarcargarcargar

SEQ ID NO: 4402 - DNA, 21 bp, Artificial Sequence
  Description of Artificial Sequence: Synthetic oligonucleotide
carcargargargarcarcar

SEQ ID NO: 4403 - DNA, 21 bp, Artificial Sequence
  Description of Artificial Sequence: Synthetic oligonucleotide
carcargargarcargarcar

SEQ ID NO: 4404 - DNA, 21 bp, Artificial Sequence
  Description of Artificial Sequence: Synthetic oligonucleotide
carcargargarcarcargar

SEQ ID NO: 4405 - DNA, 21 bp, Artificial Sequence
  Description of Artificial Sequence: Synthetic oligonucleotide
carcargarcargargarcar

SEQ ID NO: 4406 - DNA, 21 bp, Artificial Sequence
  Description of Artificial Sequence: Synthetic oligonucleotide
carcargarcargarcargar

SEQ ID NO: 4407 - DNA, 21 bp, Artificial Sequence
  Description of Artificial Sequence: Synthetic oligonucleotide
carcargarcarcargargar

SEQ ID NO: 4408 - DNA, 21 bp, Artificial Sequence
  Description of Artificial Sequence: Synthetic oligonucleotide
carcarcargargargarcar

SEQ ID NO: 4409 - DNA, 21 bp, Artificial Sequence
  Description of Artificial Sequence: Synthetic oligonucleotide
carcarcargargarcargar

SEQ ID NO: 4410 - DNA, 21 bp, Artificial Sequence
  Description of Artificial Sequence: Synthetic oligonucleotide
carcarcargarcargargar

SEQ ID NO: 4411 - DNA, 21 bp, Artificial Sequence
  Description of Artificial Sequence: Synthetic oligonucleotide
carcarcarcarcargargar

SEQ ID NO: 4412 - DNA, 21 bp, Artificial Sequence
  Description of Artificial Sequence: Synthetic oligonucleotide
gargarcarcarcarcarcar

SEQ ID NO: 4413 - DNA, 21 bp, Artificial Sequence
  Description of Artificial Sequence: Synthetic oligonucleotide
garcargarcarcarcarcar

SEQ ID NO: 4414 - DNA, 21 bp, Artificial Sequence
  Description of Artificial Sequence: Synthetic oligonucleotide
garcarcargarcarcarcar

SEQ ID NO: 4415 - DNA, 21 bp, Artificial Sequence
  Description of Artificial Sequence: Synthetic oligonucleotide
garcarcarcargarcarcar

SEQ ID NO: 4416 - DNA, 21 bp, Artificial Sequence
  Description of Artificial Sequence: Synthetic oligonucleotide
garcarcarcarcargarcar

SEQ ID NO: 4417 - DNA, 21 bp, Artificial Sequence
  Description of Artificial Sequence: Synthetic oligonucleotide
garcarcarcarcarcargar

SEQ ID NO: 4418 - DNA, 21 bp, Artificial Sequence
  Description of Artificial Sequence: Synthetic oligonucleotide
cargargarcarcarcarcar

SEQ ID NO: 4419 - DNA, 21 bp, Artificial Sequence
  Description of Artificial Sequence: Synthetic oligonucleotide
cargarcargarcarcarcar

SEQ ID NO: 4420 - DNA, 21 bp, Artificial Sequence
  Description of Artificial Sequence: Synthetic oligonucleotide
cargarcarcargarcarcar

SEQ ID NO: 4421 - DNA, 21 bp, Artificial Sequence
  Description of Artificial Sequence: Synthetic oligonucleotide
cargarcarcarcargarcar

SEQ ID NO: 4422 - DNA, 21 bp, Artificial Sequence
  Description of Artificial Sequence: Synthetic oligonucleotide
cargarcarcarcarcargar

SEQ ID NO: 4423 - DNA, 21 bp, Artificial Sequence
  Description of Artificial Sequence: Synthetic oligonucleotide
carcargargarcarcarcar

SEQ ID NO: 4424 - DNA, 21 bp, Artificial Sequence
  Description of Artificial Sequence: Synthetic oligonucleotide
carcargarcargarcarcar

SEQ ID NO: 4425 - DNA, 21 bp, Artificial Sequence
  Description of Artificial Sequence: Synthetic oligonucleotide
carcargarcarcargarcar

SEQ ID NO: 4426 - DNA, 21 bp, Artificial Sequence
  Description of Artificial Sequence: Synthetic oligonucleotide
carcargarcarcarcargar

SEQ ID NO: 4427 - DNA, 21 bp, Artificial Sequence
  Description of Artificial Sequence: Synthetic oligonucleotide
carcarcargargarcarcar

SEQ ID NO: 4428 - DNA, 21 bp, Artificial Sequence
  Description of Artificial Sequence: Synthetic oligonucleotide
carcarcargarcargarcar

SEQ ID NO: 4429 - DNA, 21 bp, Artificial Sequence
  Description of Artificial Sequence: Synthetic oligonucleotide
carcarcargarcarcargar

SEQ ID NO: 4430 - DNA, 21 bp, Artificial Sequence
  Description of Artificial Sequence: Synthetic oligonucleotide
carcarcarcargargarcar

SEQ ID NO: 4431 - DNA, 21 bp, Artificial Sequence
  Description of Artificial Sequence: Synthetic oligonucleotide
carcarcarcargarcargar

SEQ ID NO: 4432 - DNA, 21 bp, Artificial Sequence
  Description of Artificial Sequence: Synthetic oligonucleotide
carcarcarcarcarcargar

SEQ ID NO: 4433 - DNA, 21 bp, Artificial Sequence
  Description of Artificial Sequence: Synthetic oligonucleotide
garcarcarcarcarcarcar

SEQ ID NO: 4434 - DNA, 21 bp, Artificial Sequence
  Description of Artificial Sequence: Synthetic oligonucleotide
cargarcarcarcarcarcar

SEQ ID NO: 4435 - DNA, 21 bp, Artificial Sequence
  Description of Artificial Sequence: Synthetic oligonucleotide
carcargarcarcarcarcar

SEQ ID NO: 4436 - DNA, 21 bp, Artificial Sequence
  Description of Artificial Sequence: Synthetic oligonucleotide
carcarcargarcarcarcar

SEQ ID NO: 4437 - DNA, 21 bp, Artificial Sequence
  Description of Artificial Sequence: Synthetic oligonucleotide
carcarcarcargarcarcar

SEQ ID NO: 4438 - DNA, 21 bp, Artificial Sequence
  Description of Artificial Sequence: Synthetic oligonucleotide
carcarcarcarcargarcar

SEQ ID NO: 4439 - DNA, 12 bp, Artificial Sequence
  Description of Artificial Sequence: Synthetic oligonucleotide
carcarcarcay

SEQ ID NO: 4440 - DNA, 12 bp, Artificial Sequence
  Description of Artificial Sequence: Synthetic oligonucleotide
caycarcarcar

SEQ ID NO: 4441 - DNA, 12 bp, Artificial Sequence
  Description of Artificial Sequence: Synthetic oligonucleotide
carcaycarcar

SEQ ID NO: 4442 - DNA, 12 bp, Artificial Sequence
  Description of Artificial Sequence: Synthetic oligonucleotide
carcarcaycar

SEQ ID NO: 4443 - DNA, 15 bp, Artificial Sequence
  Description of Artificial Sequence: Synthetic oligonucleotide
carcarcarcarcay

SEQ ID NO: 4444 - DNA, 15 bp, Artificial Sequence
  Description of Artificial Sequence: Synthetic oligonucleotide
caycarcarcarcar

SEQ ID NO: 4445 - DNA, 15 bp, Artificial Sequence
  Description of Artificial Sequence: Synthetic oligonucleotide
carcaycarcarcar

SEQ ID NO: 4446 - DNA, 15 bp, Artificial Sequence
  Description of Artificial Sequence: Synthetic oligonucleotide
carcarcaycarcar

SEQ ID NO: 4447 - DNA, 15 bp, Artificial Sequence
  Description of Artificial Sequence: Synthetic oligonucleotide
carcarcarcaycar

SEQ ID NO: 4448 - DNA, 15 bp, Artificial Sequence
  Description of Artificial Sequence: Synthetic oligonucleotide
carcarcarcaycay

SEQ ID NO: 4449 - DNA, 15 bp, Artificial Sequence
  Description of Artificial Sequence: Synthetic oligonucleotide
caycaycarcarcar

SEQ ID NO: 4450 - DNA, 15 bp, Artificial Sequence
  Description of Artificial Sequence: Synthetic oligonucleotide
caycarcaycarcar

SEQ ID NO: 4451 - DNA, 15 bp, Artificial Sequence
  Description of Artificial Sequence: Synthetic oligonucleotide
caycarcarcaycar

SEQ ID NO: 4452 - DNA, 15 bp, Artificial Sequence
  Description of Artificial Sequence: Synthetic oligonucleotide
caycarcarcarcay

SEQ ID NO: 4453 - DNA, 15 bp, Artificial Sequence
  Description of Artificial Sequence: Synthetic oligonucleotide
carcaycaycarcar

SEQ ID NO: 4454 - DNA, 15 bp, Artificial Sequence
  Description of Artificial Sequence: Synthetic oligonucleotide
carcaycarcaycar

SEQ ID NO: 4455 - DNA, 15 bp, Artificial Sequence
  Description of Artificial Sequence: Synthetic oligonucleotide
carcaycarcarcay

SEQ ID NO: 4456 - DNA, 15 bp, Artificial Sequence
  Description of Artificial Sequence: Synthetic oligonucleotide
carcarcaycaycar

SEQ ID NO: 4457 - DNA, 15 bp, Artificial Sequence
  Description of Artificial Sequence: Synthetic oligonucleotide
carcarcaycarcay

SEQ ID NO: 4458 - DNA, 18 bp, Artificial Sequence
  Description of Artificial Sequence: Synthetic oligonucleotide
carcarcarcarcarcay

SEQ ID NO: 4459 - DNA, 18 bp, Artificial Sequence
  Description of Artificial Sequence: Synthetic oligonucleotide
caycarcarcarcarcar

SEQ ID NO: 4460 - DNA, 18 bp, Artificial Sequence
  Description of Artificial Sequence: Synthetic oligonucleotide
carcaycarcarcarcar

SEQ ID NO: 4461 - DNA, 18 bp, Artificial Sequence
  Description of Artificial Sequence: Synthetic oligonucleotide
carcarcaycarcarcar

SEQ ID NO: 4462 - DNA, 18 bp, Artificial Sequence
  Description of Artificial Sequence: Synthetic oligonucleotide
carcarcarcaycarcar

SEQ ID NO: 4463 - DNA, 18 bp, Artificial Sequence
  Description of Artificial Sequence: Synthetic oligonucleotide
carcarcarcarcaycar

SEQ ID NO: 4464 - DNA, 18 bp, Artificial Sequence
  Description of Artificial Sequence: Synthetic oligonucleotide
carcarcarcarcaycay

SEQ ID NO: 4465 - DNA, 18 bp, Artificial Sequence
  Description of Artificial Sequence: Synthetic oligonucleotide
caycaycarcarcarcar

SEQ ID NO: 4466 - DNA, 18 bp, Artificial Sequence
  Description of Artificial Sequence: Synthetic oligonucleotide
caycarcaycarcarcar

SEQ ID NO: 4467 - DNA, 18 bp, Artificial Sequence
  Description of Artificial Sequence: Synthetic oligonucleotide
caycarcarcaycarcar

SEQ ID NO: 4468 - DNA, 18 bp, Artificial Sequence
  Description of Artificial Sequence: Synthetic oligonucleotide
caycarcarcarcaycar

SEQ ID NO: 4469 - DNA, 18 bp, Artificial Sequence
  Description of Artificial Sequence: Synthetic oligonucleotide
caycarcarcarcarcay

SEQ ID NO: 4470 - DNA, 18 bp, Artificial Sequence
  Description of Artificial Sequence: Synthetic oligonucleotide
carcaycaycarcarcar

SEQ ID NO: 4471 - DNA, 18 bp, Artificial Sequence
  Description of Artificial Sequence: Synthetic oligonucleotide
carcaycarcaycarcar

SEQ ID NO: 4472 - DNA, 18 bp, Artificial Sequence
  Description of Artificial Sequence: Synthetic oligonucleotide
carcaycarcarcaycar

SEQ ID NO: 4473 - DNA, 18 bp, Artificial Sequence
  Description of Artificial Sequence: Synthetic oligonucleotide
carcaycarcarcarcay

SEQ ID NO: 4474 - DNA, 18 bp, Artificial Sequence
  Description of Artificial Sequence: Synthetic oligonucleotide
carcarcaycaycarcar

SEQ ID NO: 4475 - DNA, 18 bp, Artificial Sequence
  Description of Artificial Sequence: Synthetic oligonucleotide
carcarcaycarcaycar

SEQ ID NO: 4476 - DNA, 18 bp, Artificial Sequence
  Description of Artificial Sequence: Synthetic oligonucleotide
carcarcaycarcarcay

SEQ ID NO: 4477 - DNA, 18 bp, Artificial Sequence
  Description of Artificial Sequence: Synthetic oligonucleotide
carcarcarcaycaycar

SEQ ID NO: 4478 - DNA, 18 bp, Artificial Sequence
  Description of Artificial Sequence: Synthetic oligonucleotide
carcarcarcaycarcay

SEQ ID NO: 4479 - DNA, 21 bp, Artificial Sequence
  Description of Artificial Sequence: Synthetic oligonucleotide
carcarcarcarcaycaycay

SEQ ID NO: 4480 - DNA, 21 bp, Artificial Sequence
  Description of Artificial Sequence: Synthetic oligonucleotide
caycaycaycarcarcarcar

SEQ ID NO: 4481 - DNA, 21 bp, Artificial Sequence
  Description of Artificial Sequence: Synthetic oligonucleotide
caycarcaycaycarcarcar

SEQ ID NO: 4482 - DNA, 21 bp, Artificial Sequence
  Description of Artificial Sequence: Synthetic oligonucleotide
caycarcaycarcaycarcar

SEQ ID NO: 4483 - DNA, 21 bp, Artificial Sequence
  Description of Artificial Sequence: Synthetic oligonucleotide
caycarcaycarcarcaycar

SEQ ID NO: 4484 - DNA, 21 bp, Artificial Sequence
  Description of Artificial Sequence: Synthetic oligonucleotide
caycarcaycarcarcarcay

SEQ ID NO: 4485 - DNA, 21 bp, Artificial Sequence
  Description of Artificial Sequence: Synthetic oligonucleotide
caycarcarcaycaycarcar

SEQ ID NO: 4486 - DNA, 21 bp, Artificial Sequence
  Description of Artificial Sequence: Synthetic oligonucleotide
caycarcarcaycarcaycar

SEQ ID NO: 4487 - DNA, 21 bp, Artificial Sequence
  Description of Artificial Sequence: Synthetic oligonucleotide
caycarcarcaycarcarcay

SEQ ID NO: 4488 - DNA, 21 bp, Artificial Sequence
  Description of Artificial Sequence: Synthetic oligonucleotide
caycarcarcarcaycarcay

SEQ ID NO: 4489 - DNA, 21 bp, Artificial Sequence
  Description of Artificial Sequence: Synthetic oligonucleotide
caycarcarcarcaycaycar

SEQ ID NO: 4490 - DNA, 21 bp, Artificial Sequence
  Description of Artificial Sequence: Synthetic oligonucleotide
caycarcarcarcarcaycay

SEQ ID NO: 4491 - DNA, 21 bp, Artificial Sequence
  Description of Artificial Sequence: Synthetic oligonucleotide
caycaycarcaycarcarcar

SEQ ID NO: 4492 - DNA, 21 bp, Artificial Sequence
  Description of Artificial Sequence: Synthetic oligonucleotide
caycaycarcarcaycarcar

SEQ ID NO: 4493 - DNA, 21 bp, Artificial Sequence
  Description of Artificial Sequence: Synthetic oligonucleotide
caycaycarcarcarcaycar

SEQ ID NO: 4494 - DNA, 21 bp, Artificial Sequence
  Description of Artificial Sequence: Synthetic oligonucleotide
caycaycarcarcarcarcay

SEQ ID NO: 4495 - DNA, 21 bp, Artificial Sequence
  Description of Artificial Sequence: Synthetic oligonucleotide
carcaycaycaycarcarcar

SEQ ID NO: 4496 - DNA, 21 bp, Artificial Sequence
  Description of Artificial Sequence: Synthetic oligonucleotide
carcaycaycarcaycarcar

SEQ ID NO: 4497 - DNA, 21 bp, Artificial Sequence
  Description of Artificial Sequence: Synthetic oligonucleotide
carcaycaycarcarcaycar

SEQ ID NO: 4498 - DNA, 21 bp, Artificial Sequence
  Description of Artificial Sequence: Synthetic oligonucleotide
carcaycaycarcarcarcay

SEQ ID NO: 4499 - DNA, 21 bp, Artificial Sequence
  Description of Artificial Sequence: Synthetic oligonucleotide
carcaycarcaycaycarcar

SEQ ID NO: 4500 - DNA, 21 bp, Artificial Sequence
  Description of Artificial Sequence: Synthetic oligonucleotide
carcaycarcarcaycaycar

SEQ ID NO: 4501 - DNA, 21 bp, Artificial Sequence
  Description of Artificial Sequence: Synthetic oligonucleotide
carcaycarcarcarcaycay

SEQ ID NO: 4502 - DNA, 21 bp, Artificial Sequence
  Description of Artificial Sequence: Synthetic oligonucleotide
carcaycarcaycarcaycar

SEQ ID NO: 4503 - DNA, 21 bp, Artificial Sequence
  Description of Artificial Sequence: Synthetic oligonucleotide
carcaycarcaycarcarcay

SEQ ID NO: 4504 - DNA, 21 bp, Artificial Sequence
  Description of Artificial Sequence: Synthetic oligonucleotide
carcaycarcarcaycarcay

SEQ ID NO: 4505 - DNA, 21 bp, Artificial Sequence
  Description of Artificial Sequence: Synthetic oligonucleotide
carcarcaycaycaycarcar

SEQ ID NO: 4506 - DNA, 21 bp, Artificial Sequence
  Description of Artificial Sequence: Synthetic oligonucleotide
carcarcaycaycarcaycar

SEQ ID NO: 4507 - DNA, 21 bp, Artificial Sequence
  Description of Artificial Sequence: Synthetic oligonucleotide
carcarcaycaycarcarcay

SEQ ID NO: 4508 - DNA, 21 bp, Artificial Sequence
  Description of Artificial Sequence: Synthetic oligonucleotide
carcarcaycarcaycaycar

SEQ ID NO: 4509 - DNA, 21 bp, Artificial Sequence
  Description of Artificial Sequence: Synthetic oligonucleotide
carcarcaycarcaycarcay

SEQ ID NO: 4510 - DNA, 21 bp, Artificial Sequence
  Description of Artificial Sequence: Synthetic oligonucleotide
carcarcaycarcarcaycay

SEQ ID NO: 4511 - DNA, 21 bp, Artificial Sequence
  Description of Artificial Sequence: Synthetic oligonucleotide
carcarcarcaycaycaycar

SEQ ID NO: 4512 - DNA, 21 bp, Artificial Sequence
  Description of Artificial Sequence: Synthetic oligonucleotide
carcarcarcaycaycarcay

SEQ ID NO: 4513 - DNA, 21 bp, Artificial Sequence
  Description of Artificial Sequence: Synthetic oligonucleotide
carcarcarcaycarcaycay

SEQ ID NO: 4514 - DNA, 21 bp, Artificial Sequence
  Description of Artificial Sequence: Synthetic oligonucleotide
carcarcarcarcarcaycay

SEQ ID NO: 4515 - DNA, 21 bp, Artificial Sequence
  Description of Artificial Sequence: Synthetic oligonucleotide
caycaycarcarcarcarcar

SEQ ID NO: 4516 - DNA, 21 bp, Artificial Sequence
  Description of Artificial Sequence: Synthetic oligonucleotide
caycarcaycarcarcarcar

SEQ ID NO: 4517 - DNA, 21 bp, Artificial Sequence
  Description of Artificial Sequence: Synthetic oligonucleotide
caycarcarcaycarcarcar

SEQ ID NO: 4518 - DNA, 21 bp, Artificial Sequence
  Description of Artificial Sequence: Synthetic oligonucleotide
caycarcarcarcaycarcar

SEQ ID NO: 4519 - DNA, 21 bp, Artificial Sequence
  Description of Artificial Sequence: Synthetic oligonucleotide
caycarcarcarcarcaycar

SEQ ID NO: 4520 - DNA, 21 bp, Artificial Sequence
  Description of Artificial Sequence: Synthetic oligonucleotide
caycarcarcarcarcarcay

SEQ ID NO: 4521 - DNA, 21 bp, Artificial Sequence
  Description of Artificial Sequence: Synthetic oligonucleotide
carcaycaycarcarcarcar

SEQ ID NO: 4522 - DNA, 21 bp, Artificial Sequence
  Description of Artificial Sequence: Synthetic oligonucleotide
carcaycarcaycarcarcar

SEQ ID NO: 4523 - DNA, 21 bp, Artificial Sequence
  Description of Artificial Sequence: Synthetic oligonucleotide
carcaycarcarcaycarcar

SEQ ID NO: 4524 - DNA, 21 bp, Artificial Sequence
  Description of Artificial Sequence: Synthetic oligonucleotide
carcaycarcarcarcaycar

SEQ ID NO: 4525 - DNA, 21 bp, Artificial Sequence
  Description of Artificial Sequence: Synthetic oligonucleotide
carcaycarcarcarcarcay

SEQ ID NO: 4526 - DNA, 21 bp, Artificial Sequence
  Description of Artificial Sequence: Synthetic oligonucleotide
carcarcaycaycarcarcar

SEQ ID NO: 4527 - DNA, 21 bp, Artificial Sequence
  Description of Artificial Sequence: Synthetic oligonucleotide
carcarcaycarcaycarcar

SEQ ID NO: 4528 - DNA, 21 bp, Artificial Sequence
  Description of Artificial Sequence: Synthetic oligonucleotide
carcarcaycarcarcaycar

SEQ ID NO: 4529 - DNA, 21 bp, Artificial Sequence
  Description of Artificial Sequence: Synthetic oligonucleotide
carcarcaycarcarcarcay

SEQ ID NO: 4530 - DNA, 21 bp, Artificial Sequence
  Description of Artificial Sequence: Synthetic oligonucleotide
carcarcarcaycaycarcar

SEQ ID NO: 4531 - DNA, 21 bp, Artificial Sequence
  Description of Artificial Sequence: Synthetic oligonucleotide
carcarcarcaycarcaycar

SEQ ID NO: 4532 - DNA, 21 bp, Artificial Sequence
  Description of Artificial Sequence: Synthetic oligonucleotide
carcarcarcaycarcarcay

SEQ ID NO: 4533 - DNA, 21 bp, Artificial Sequence
  Description of Artificial Sequence: Synthetic oligonucleotide
carcarcarcarcaycaycar

SEQ ID NO: 4534 - DNA, 21 bp, Artificial Sequence
  Description of Artificial Sequence: Synthetic oligonucleotide
carcarcarcarcaycarcay

SEQ ID NO: 4535 - DNA, 21 bp, Artificial Sequence
  Description of Artificial Sequence: Synthetic oligonucleotide
carcarcarcarcarcarcay

SEQ ID NO: 4536 - DNA, 21 bp, Artificial Sequence
  Description of Artificial Sequence: Synthetic oligonucleotide
caycarcarcarcarcarcar

SEQ ID NO: 4537 - DNA, 21 bp, Artificial Sequence
  Description of Artificial Sequence: Synthetic oligonucleotide
carcaycarcarcarcarcar

SEQ ID NO: 4538 - DNA, 21 bp, Artificial Sequence
  Description of Artificial Sequence: Synthetic oligonucleotide
carcarcaycarcarcarcar

SEQ ID NO: 4539 - DNA, 21 bp, Artificial Sequence
  Description of Artificial Sequence: Synthetic oligonucleotide
carcarcarcaycarcarcar

SEQ ID NO: 4540 - DNA, 21 bp, Artificial Sequence
  Description of Artificial Sequence: Synthetic oligonucleotide
carcarcarcarcaycarcar

SEQ ID NO: 4541 - DNA, 21 bp, Artificial Sequence
  Description of Artificial Sequence: Synthetic oligonucleotide
carcarcarcarcarcaycar

SEQ ID NO: 4542 - DNA, 12 bp, Artificial Sequence
  Description of Artificial Sequence: Synthetic oligonucleotide
carcarcaraay

SEQ ID NO: 4543 - DNA, 12 bp, Artificial Sequence
  Description of Artificial Sequence: Synthetic oligonucleotide
aaycarcarcar

SEQ ID NO: 4544 - DNA, 12 bp, Artificial Sequence
  Description of Artificial Sequence: Synthetic oligonucleotide
caraaycarcar

SEQ ID NO: 4545 - DNA, 12 bp, Artificial Sequence
  Description of Artificial Sequence: Synthetic oligonucleotide
carcaraaycar

SEQ ID NO: 4546 - DNA, 15 bp, Artificial Sequence
  Description of Artificial Sequence: Synthetic oligonucleotide
carcarcarcaraay

SEQ ID NO: 4547 - DNA, 15 bp, Artificial Sequence
  Description of Artificial Sequence: Synthetic oligonucleotide
aaycarcarcarcar

SEQ ID NO: 4548 - DNA, 15 bp, Artificial Sequence
  Description of Artificial Sequence: Synthetic oligonucleotide
caraaycarcarcar

SEQ ID NO: 4549 - DNA, 15 bp, Artificial Sequence
  Description of Artificial Sequence: Synthetic oligonucleotide
carcaraaycarcar

SEQ ID NO: 4550 - DNA, 15 bp, Artificial Sequence
  Description of Artificial Sequence: Synthetic oligonucleotide
carcarcaraaycar

SEQ ID NO: 4551 - DNA, 15 bp, Artificial Sequence
  Description of Artificial Sequence: Synthetic oligonucleotide
carcarcaraayaay

SEQ ID NO: 4552 - DNA, 15 bp, Artificial Sequence
  Description of Artificial Sequence: Synthetic oligonucleotide
aayaaycarcarcar

SEQ ID NO: 4553 - DNA, 15 bp, Artificial Sequence
  Description of Artificial Sequence: Synthetic oligonucleotide
aaycaraaycarcar

SEQ ID NO: 4554 - DNA, 15 bp, Artificial Sequence
  Description of Artificial Sequence: Synthetic oligonucleotide
aaycarcaraaycar

SEQ ID NO: 4555 - DNA, 15 bp, Artificial Sequence
  Description of Artificial Sequence: Synthetic oligonucleotide
aaycarcarcaraay

SEQ ID NO: 4556 - DNA, 15 bp, Artificial Sequence
  Description of Artificial Sequence: Synthetic oligonucleotide
caraayaaycarcar

SEQ ID NO: 4557 - DNA, 15 bp, Artificial Sequence
  Description of Artificial Sequence: Synthetic oligonucleotide
caraaycaraaycar

SEQ ID NO: 4558 - DNA, 15 bp, Artificial Sequence
  Description of Artificial Sequence: Synthetic oligonucleotide
caraaycarcaraay

SEQ ID NO: 4559 - DNA, 15 bp, Artificial Sequence
  Description of Artificial Sequence: Synthetic oligonucleotide
carcaraayaaycar

SEQ ID NO: 4560 - DNA, 15 bp, Artificial Sequence
  Description of Artificial Sequence: Synthetic oligonucleotide
carcaraaycaraay

SEQ ID NO: 4561 - DNA, 18 bp, Artificial Sequence
  Description of Artificial Sequence: Synthetic oligonucleotide
carcarcarcarcaraay

SEQ ID NO: 4562 - DNA, 18 bp, Artificial Sequence
  Description of Artificial Sequence: Synthetic oligonucleotide
aaycarcarcarcarcar

SEQ ID NO: 4563 - DNA, 18 bp, Artificial Sequence
  Description of Artificial Sequence: Synthetic oligonucleotide
caraaycarcarcarcar

SEQ ID NO: 4564 - DNA, 18 bp, Artificial Sequence
  Description of Artificial Sequence: Synthetic oligonucleotide
carcaraaycarcarcar

SEQ ID NO: 4565 - DNA, 18 bp, Artificial Sequence
  Description of Artificial Sequence: Synthetic oligonucleotide
carcarcaraaycarcar

SEQ ID NO: 4566 - DNA, 18 bp, Artificial Sequence
  Description of Artificial Sequence: Synthetic oligonucleotide
carcarcarcaraaycar

SEQ ID NO: 4567 - DNA, 18 bp, Artificial Sequence
  Description of Artificial Sequence: Synthetic oligonucleotide
carcarcarcaraayaay

SEQ ID NO: 4568 - DNA, 18 bp, Artificial Sequence
  Description of Artificial Sequence: Synthetic oligonucleotide
aayaaycarcarcarcar

SEQ ID NO: 4569 - DNA, 18 bp, Artificial Sequence
  Description of Artificial Sequence: Synthetic oligonucleotide
aaycaraaycarcarcar

SEQ ID NO: 4570 - DNA, 18 bp, Artificial Sequence
  Description of Artificial Sequence: Synthetic oligonucleotide
aaycarcaraaycarcar

SEQ ID NO: 4571 - DNA, 18 bp, Artificial Sequence
  Description of Artificial Sequence: Synthetic oligonucleotide
aaycarcarcaraaycar

SEQ ID NO: 4572 - DNA, 18 bp, Artificial Sequence
  Description of Artificial Sequence: Synthetic oligonucleotide
aaycarcarcarcaraay

SEQ ID NO: 4573 - DNA, 18 bp, Artificial Sequence
  Description of Artificial Sequence: Synthetic oligonucleotide
caraayaaycarcarcar

SEQ ID NO: 4574 - DNA, 18 bp, Artificial Sequence
  Description of Artificial Sequence: Synthetic oligonucleotide
caraaycaraaycarcar

SEQ ID NO: 4575 - DNA, 18 bp, Artificial Sequence
  Description of Artificial Sequence: Synthetic oligonucleotide
caraaycarcaraaycar

SEQ ID NO: 4576 - DNA, 18 bp, Artificial Sequence
  Description of Artificial Sequence: Synthetic oligonucleotide
caraaycarcarcaraay

SEQ ID NO: 4577 - DNA, 18 bp, Artificial Sequence
  Description of Artificial Sequence: Synthetic oligonucleotide
carcaraayaaycarcar

SEQ ID NO: 4578 - DNA, 18 bp, Artificial Sequence
  Description of Artificial Sequence: Synthetic oligonucleotide
carcaraaycaraaycar

SEQ ID NO: 4579 - DNA, 18 bp, Artificial Sequence
  Description of Artificial Sequence: Synthetic oligonucleotide
carcaraaycarcaraay

SEQ ID NO: 4580 - DNA, 18 bp, Artificial Sequence
  Description of Artificial Sequence: Synthetic oligonucleotide
carcarcaraayaaycar

SEQ ID NO: 4581 - DNA, 18 bp, Artificial Sequence
  Description of Artificial Sequence: Synthetic oligonucleotide
carcarcaraaycaraay

SEQ ID NO: 4582 - DNA, 21 bp, Artificial Sequence
  Description of Artificial Sequence: Synthetic oligonucleotide
carcarcarcaraayaayaay

SEQ ID NO: 4583 - DNA, 21 bp, Artificial Sequence
  Description of Artificial Sequence: Synthetic oligonucleotide
aayaayaaycarcarcarcar

SEQ ID NO: 4584 - DNA, 21 bp, Artificial Sequence
  Description of Artificial Sequence: Synthetic oligonucleotide
aaycaraayaaycarcarcar

SEQ ID NO: 4585 - DNA, 21 bp, Artificial Sequence
  Description of Artificial Sequence: Synthetic oligonucleotide
aaycaraaycaraaycarcar

SEQ ID NO: 4586 - DNA, 21 bp, Artificial Sequence
  Description of Artificial Sequence: Synthetic oligonucleotide
aaycaraaycarcaraaycar

SEQ ID NO: 4587 - DNA, 21 bp, Artificial Sequence
  Description of Artificial Sequence: Synthetic oligonucleotide
aaycaraaycarcarcaraay

SEQ ID NO: 4588 - DNA, 21 bp, Artificial Sequence
  Description of Artificial Sequence: Synthetic oligonucleotide
aaycarcaraayaaycarcar

SEQ ID NO: 4589 - DNA, 21 bp, Artificial Sequence
  Description of Artificial Sequence: Synthetic oligonucleotide
aaycarcaraaycaraaycar

SEQ ID NO: 4590 - DNA, 21 bp, Artificial Sequence
  Description of Artificial Sequence: Synthetic oligonucleotide
aaycarcaraaycarcaraay

SEQ ID NO: 4591 - DNA, 21 bp, Artificial Sequence
  Description of Artificial Sequence: Synthetic oligonucleotide
aaycarcarcaraaycaraay

SEQ ID NO: 4592 - DNA, 21 bp, Artificial Sequence
  Description of Artificial Sequence: Synthetic oligonucleotide
aaycarcarcaraayaaycar

SEQ ID NO: 4593 - DNA, 21 bp, Artificial Sequence
  Description of Artificial Sequence: Synthetic oligonucleotide
aaycarcarcarcaraayaay

SEQ ID NO: 4594 - DNA, 21 bp, Artificial Sequence
  Description of Artificial Sequence: Synthetic oligonucleotide
aayaaycaraaycarcarcar

SEQ ID NO: 4595 - DNA, 21 bp, Artificial Sequence
  Description of Artificial Sequence: Synthetic oligonucleotide
aayaaycarcaraaycarcar

SEQ ID NO: 4596 - DNA, 21 bp, Artificial Sequence
  Description of Artificial Sequence: Synthetic oligonucleotide
aayaaycarcarcaraaycar

SEQ ID NO: 4597 - DNA, 21 bp, Artificial Sequence
  Description of Artificial Sequence: Synthetic oligonucleotide
aayaaycarcarcarcaraay

SEQ ID NO: 4598 - DNA, 21 bp, Artificial Sequence
  Description of Artificial Sequence: Synthetic oligonucleotide
caraayaayaaycarcarcar

SEQ ID NO: 4599 - DNA, 21 bp, Artificial Sequence
  Description of Artificial Sequence: Synthetic oligonucleotide
caraayaaycaraaycarcar

SEQ ID NO: 4600 - DNA, 21 bp, Artificial Sequence
  Description of Artificial Sequence: Synthetic oligonucleotide
caraayaaycarcaraaycar

SEQ ID NO: 4601 - DNA, 21 bp, Artificial Sequence
  Description of Artificial Sequence: Synthetic oligonucleotide
caraayaaycarcarcaraay

SEQ ID NO: 4602 - DNA, 21 bp, Artificial Sequence
  Description of Artificial Sequence: Synthetic oligonucleotide
caraaycaraayaaycarcar

SEQ ID NO: 4603 - DNA, 21 bp, Artificial Sequence
  Description of Artificial Sequence: Synthetic oligonucleotide
caraaycarcaraayaaycar

SEQ ID NO: 4604 - DNA, 21 bp, Artificial Sequence
  Description of Artificial Sequence: Synthetic oligonucleotide
caraaycarcarcaraayaay

SEQ ID NO: 4605 - DNA, 21 bp, Artificial Sequence
  Description of Artificial Sequence: Synthetic oligonucleotide
caraaycaraaycaraaycar

SEQ ID NO: 4606 - DNA, 21 bp, Artificial Sequence
  Description of Artificial Sequence: Synthetic oligonucleotide
caraaycaraaycarcaraay

SEQ ID NO: 4607 - DNA, 21 bp, Artificial Sequence
  Description of Artificial Sequence: Synthetic oligonucleotide
caraaycarcaraaycaraay

SEQ ID NO: 4608 - DNA, 21 bp, Artificial Sequence
  Description of Artificial Sequence: Synthetic oligonucleotide
carcaraayaayaaycarcar

SEQ ID NO: 4609 - DNA, 21 bp, Artificial Sequence
  Description of Artificial Sequence: Synthetic oligonucleotide
carcaraayaaycaraaycar

SEQ ID NO: 4610 - DNA, 21 bp, Artificial Sequence
  Description of Artificial Sequence: Synthetic oligonucleotide
carcaraayaaycarcaraay

SEQ ID NO: 4611 - DNA, 21 bp, Artificial Sequence
  Description of Artificial Sequence: Synthetic oligonucleotide
carcaraaycaraayaaycar

SEQ ID NO: 4612 - DNA, 21 bp, Artificial Sequence
  Description of Artificial Sequence: Synthetic oligonucleotide
carcaraaycaraaycaraay

SEQ ID NO: 4613 - DNA, 21 bp, Artificial Sequence
  Description of Artificial Sequence: Synthetic oligonucleotide
carcaraaycarcaraayaay

SEQ ID NO: 4614 - DNA, 21 bp, Artificial Sequence
  Description of Artificial Sequence: Synthetic oligonucleotide
carcarcaraayaayaaycar

SEQ ID NO: 4615 - DNA, 21 bp, Artificial Sequence
  Description of Artificial Sequence: Synthetic oligonucleotide
carcarcaraayaaycaraay

SEQ ID NO: 4616 - DNA, 21 bp, Artificial Sequence
  Description of Artificial Sequence: Synthetic oligonucleotide
carcarcaraaycaraayaay

SEQ ID NO: 4617 - DNA, 21 bp, Artificial Sequence
  Description of Artificial Sequence: Synthetic oligonucleotide
carcarcarcarcaraayaay

SEQ ID NO: 4618 - DNA, 21 bp, Artificial Sequence
  Description of Artificial Sequence: Synthetic oligonucleotide
aayaaycarcarcarcarcar

SEQ ID NO: 4619 - DNA, 21 bp, Artificial Sequence
  Description of Artificial Sequence: Synthetic oligonucleotide
aaycaraaycarcarcarcar

SEQ ID NO: 4620 - DNA, 21 bp, Artificial Sequence
  Description of Artificial Sequence: Synthetic oligonucleotide
aaycarcaraaycarcarcar

SEQ ID NO: 4621 - DNA, 21 bp, Artificial Sequence
  Description of Artificial Sequence: Synthetic oligonucleotide
aaycarcarcaraaycarcar

SEQ ID NO: 4622 - DNA, 21 bp, Artificial Sequence
  Description of Artificial Sequence: Synthetic oligonucleotide
aaycarcarcarcaraaycar

SEQ ID NO: 4623 - DNA, 21 bp, Artificial Sequence
  Description of Artificial Sequence: Synthetic oligonucleotide
aaycarcarcarcarcaraay

SEQ ID NO: 4624 - DNA, 21 bp, Artificial Sequence
  Description of Artificial Sequence: Synthetic oligonucleotide
caraayaaycarcarcarcar

SEQ ID NO: 4625 - DNA, 21 bp, Artificial Sequence
  Description of Artificial Sequence: Synthetic oligonucleotide
caraaycaraaycarcarcar

SEQ ID NO: 4626 - DNA, 21 bp, Artificial Sequence
  Description of Artificial Sequence: Synthetic oligonucleotide
caraaycarcaraaycarcar

SEQ ID NO: 4627 - DNA, 21 bp, Artificial Sequence
  Description of Artificial Sequence: Synthetic oligonucleotide
caraaycarcarcaraaycar

SEQ ID NO: 4628 - DNA, 21 bp, Artificial Sequence
  Description of Artificial Sequence: Synthetic oligonucleotide
caraaycarcarcarcaraay

SEQ ID NO: 4629 - DNA, 21 bp, Artificial Sequence
  Description of Artificial Sequence: Synthetic oligonucleotide
carcaraayaaycarcarcar

SEQ ID NO: 4630 - DNA, 21 bp, Artificial Sequence
  Description of Artificial Sequence: Synthetic oligonucleotide
carcaraaycaraaycarcar

SEQ ID NO: 4631 - DNA, 21 bp, Artificial Sequence
  Description of Artificial Sequence: Synthetic oligonucleotide
carcaraaycarcaraaycar

SEQ ID NO: 4632 - DNA, 21 bp, Artificial Sequence
  Description of Artificial Sequence: Synthetic oligonucleotide
carcaraaycarcarcaraay

SEQ ID NO: 4633 - DNA, 21 bp, Artificial Sequence
  Description of Artificial Sequence: Synthetic oligonucleotide
carcarcaraayaaycarcar

SEQ ID NO: 4634 - DNA, 21 bp, Artificial Sequence
  Description of Artificial Sequence: Synthetic oligonucleotide
carcarcaraaycaraaycar

SEQ ID NO: 4635 - DNA, 21 bp, Artificial Sequence
  Description of Artificial Sequence: Synthetic oligonucleotide
carcarcaraaycarcaraay

SEQ ID NO: 4636 - DNA, 21 bp, Artificial Sequence
  Description of Artificial Sequence: Synthetic oligonucleotide
carcarcarcaraayaaycar

SEQ ID NO: 4637 - DNA, 21 bp, Artificial Sequence
  Description of Artificial Sequence: Synthetic oligonucleotide
carcarcarcaraaycaraay

SEQ ID NO: 4638 - DNA, 21 bp, Artificial Sequence
  Description of Artificial Sequence: Synthetic oligonucleotide
carcarcarcarcarcaraay

SEQ ID NO: 4639 - DNA, 21 bp, Artificial Sequence
  Description of Artificial Sequence: Synthetic oligonucleotide
aaycarcarcarcarcarcar

SEQ ID NO: 4640 - DNA, 21 bp, Artificial Sequence
  Description of Artificial Sequence: Synthetic oligonucleotide
caraaycarcarcarcarcar

SEQ ID NO: 4641 - DNA, 21 bp, Artificial Sequence
  Description of Artificial Sequence: Synthetic oligonucleotide
carcaraaycarcarcarcar

SEQ ID NO: 4642 - DNA, 21 bp, Artificial Sequence
  Description of Artificial Sequence: Synthetic oligonucleotide
carcarcaraaycarcarcar

SEQ ID NO: 4643 - DNA, 21 bp, Artificial Sequence
  Description of Artificial Sequence: Synthetic oligonucleotide
carcarcarcaraaycarcar

SEQ ID NO: 4644 - DNA, 21 bp, Artificial Sequence
  Description of Artificial Sequence: Synthetic oligonucleotide
carcarcarcarcaraaycar

SEQ ID NO: 4645 - DNA, 12 bp, Artificial Sequence
  Description of Artificial Sequence: Synthetic oligonucleotide
carcarcargay

SEQ ID NO: 4646 - DNA, 12 bp, Artificial Sequence
  Description of Artificial Sequence: Synthetic oligonucleotide
gaycarcarcar

SEQ ID NO: 4647 - DNA, 12 bp, Artificial Sequence
  Description of Artificial Sequence: Synthetic oligonucleotide
cargaycarcar

SEQ ID NO: 4648 - DNA, 12 bp, Artificial Sequence
  Description of Artificial Sequence: Synthetic oligonucleotide
carcargaycar

SEQ ID NO: 4649 - DNA, 15 bp, Artificial Sequence
  Description of Artificial Sequence: Synthetic oligonucleotide
carcarcarcargay

SEQ ID NO: 4650 - DNA, 15 bp, Artificial Sequence
  Description of Artificial Sequence: Synthetic oligonucleotide
gaycarcarcarcar

SEQ ID NO: 4651 - DNA, 15 bp, Artificial Sequence
  Description of Artificial Sequence: Synthetic oligonucleotide
cargaycarcarcar

SEQ ID NO: 4652 - DNA, 15 bp, Artificial Sequence
  Description of Artificial Sequence: Synthetic oligonucleotide
carcargaycarcar

SEQ ID NO: 4653 - DNA, 15 bp, Artificial Sequence
  Description of Artificial Sequence: Synthetic oligonucleotide
carcarcargaycar

SEQ ID NO: 4654 - DNA, 15 bp, Artificial Sequence
  Description of Artificial Sequence: Synthetic oligonucleotide
carcarcargaygay

SEQ ID NO: 4655 - DNA, 15 bp, Artificial Sequence
  Description of Artificial Sequence: Synthetic oligonucleotide
gaygaycarcarcar

SEQ ID NO: 4656 - DNA, 15 bp, Artificial Sequence
  Description of Artificial Sequence: Synthetic oligonucleotide
gaycargaycarcar

SEQ ID NO: 4657 - DNA, 15 bp, Artificial Sequence
  Description of Artificial Sequence: Synthetic oligonucleotide
gaycarcargaycar

SEQ ID NO: 4658 - DNA, 15 bp, Artificial Sequence
  Description of Artificial Sequence: Synthetic oligonucleotide
gaycarcarcargay

SEQ ID NO: 4659 - DNA, 15 bp, Artificial Sequence
  Description of Artificial Sequence: Synthetic oligonucleotide
cargaygaycarcar

SEQ ID NO: 4660 - DNA, 15 bp, Artificial Sequence
  Description of Artificial Sequence: Synthetic oligonucleotide
cargaycargaycar

SEQ ID NO: 4661 - DNA, 15 bp, Artificial Sequence
  Description of Artificial Sequence: Synthetic oligonucleotide
cargaycarcargay

SEQ ID NO: 4662 - DNA, 15 bp, Artificial Sequence
  Description of Artificial Sequence: Synthetic oligonucleotide
carcargaygaycar

SEQ ID NO: 4663 - DNA, 15 bp, Artificial Sequence
  Description of Artificial Sequence: Synthetic oligonucleotide
carcargaycargay

SEQ ID NO: 4664 - DNA, 18 bp, Artificial Sequence
  Description of Artificial Sequence: Synthetic oligonucleotide
carcarcarcarcargay

SEQ ID NO: 4665 - DNA, 18 bp, Artificial Sequence
  Description of Artificial Sequence: Synthetic oligonucleotide
gaycarcarcarcarcar

SEQ ID NO: 4666 - DNA, 18 bp, Artificial Sequence
  Description of Artificial Sequence: Synthetic oligonucleotide
cargaycarcarcarcar

SEQ ID NO: 4667 - DNA, 18 bp, Artificial Sequence
  Description of Artificial Sequence: Synthetic oligonucleotide
carcargaycarcarcar

SEQ ID NO: 4668 - DNA, 18 bp, Artificial Sequence
  Description of Artificial Sequence: Synthetic oligonucleotide
carcarcargaycarcar

SEQ ID NO: 4669 - DNA, 18 bp, Artificial Sequence
  Description of Artificial Sequence: Synthetic oligonucleotide
carcarcarcargaycar

SEQ ID NO: 4670 - DNA, 18 bp, Artificial Sequence
  Description of Artificial Sequence: Synthetic oligonucleotide
carcarcarcargaygay

SEQ ID NO: 4671 - DNA, 18 bp, Artificial Sequence
  Description of Artificial Sequence: Synthetic oligonucleotide
gaygaycarcarcarcar

SEQ ID NO: 4672 - DNA, 18 bp, Artificial Sequence
  Description of Artificial Sequence: Synthetic oligonucleotide
gaycargaycarcarcar

SEQ ID NO: 4673 - DNA, 18 bp, Artificial Sequence
  Description of Artificial Sequence: Synthetic oligonucleotide
gaycarcargaycarcar

SEQ ID NO: 4674 - DNA, 18 bp, Artificial Sequence
  Description of Artificial Sequence: Synthetic oligonucleotide
gaycarcarcargaycar

SEQ ID NO: 4675 - DNA, 18 bp, Artificial Sequence
  Description of Artificial Sequence: Synthetic oligonucleotide
gaycarcarcarcargay

SEQ ID NO: 4676 - DNA, 18 bp, Artificial Sequence
  Description of Artificial Sequence: Synthetic oligonucleotide
cargaygaycarcarcar

SEQ ID NO: 4677 - DNA, 18 bp, Artificial Sequence
  Description of Artificial Sequence: Synthetic oligonucleotide
cargaycargaycarcar

SEQ ID NO: 4678 - DNA, 18 bp, Artificial Sequence
  Description of Artificial Sequence: Synthetic oligonucleotide
cargaycarcargaycar

SEQ ID NO: 4679 - DNA, 18 bp, Artificial Sequence
  Description of Artificial Sequence: Synthetic oligonucleotide
cargaycarcarcargay

SEQ ID NO: 4680 - DNA, 18 bp, Artificial Sequence
  Description of Artificial Sequence: Synthetic oligonucleotide
carcargaygaycarcar

SEQ ID NO: 4681 - DNA, 18 bp, Artificial Sequence
  Description of Artificial Sequence: Synthetic oligonucleotide
carcargaycargaycar

SEQ ID NO: 4682 - DNA, 18 bp, Artificial Sequence
  Description of Artificial Sequence: Synthetic oligonucleotide
carcargaycarcargay

SEQ ID NO: 4683 - DNA, 18 bp, Artificial Sequence
  Description of Artificial Sequence: Synthetic oligonucleotide
carcarcargaygaycar

SEQ ID NO: 4684 - DNA, 18 bp, Artificial Sequence
  Description of Artificial Sequence: Synthetic oligonucleotide
carcarcargaycargay

SEQ ID NO: 4685 - DNA, 21 bp, Artificial Sequence
  Description of Artificial Sequence: Synthetic oligonucleotide
carcarcarcargaygaygay

SEQ ID NO: 4686 - DNA, 21 bp, Artificial Sequence
  Description of Artificial Sequence: Synthetic oligonucleotide
gaygaygaycarcarcarcar

SEQ ID NO: 4687 - DNA, 21 bp, Artificial Sequence
  Description of Artificial Sequence: Synthetic oligonucleotide
gaycargaygaycarcarcar

SEQ ID NO: 4688 - DNA, 21 bp, Artificial Sequence
  Description of Artificial Sequence: Synthetic oligonucleotide
gaycargaycargaycarcar

SEQ ID NO: 4689 - DNA, 21 bp, Artificial Sequence
  Description of Artificial Sequence: Synthetic oligonucleotide
gaycargaycarcargaycar

SEQ ID NO: 4690 - DNA, 21 bp, Artificial Sequence
  Description of Artificial Sequence: Synthetic oligonucleotide
gaycargaycarcarcargay

SEQ ID NO: 4691 - DNA, 21 bp, Artificial Sequence
  Description of Artificial Sequence: Synthetic oligonucleotide
gaycarcargaygaycarcar

SEQ ID NO: 4692 - DNA, 21 bp, Artificial Sequence
  Description of Artificial Sequence: Synthetic oligonucleotide
gaycarcargaycargaycar

SEQ ID NO: 4693 - DNA, 21 bp, Artificial Sequence
  Description of Artificial Sequence: Synthetic oligonucleotide
gaycarcargaycarcargay

SEQ ID NO: 4694 - DNA, 21 bp, Artificial Sequence
  Description of Artificial Sequence: Synthetic oligonucleotide
gaycarcarcargaycargay

SEQ ID NO: 4695 - DNA, 21 bp, Artificial Sequence
  Description of Artificial Sequence: Synthetic oligonucleotide
gaycarcarcargaygaycar

SEQ ID NO: 4696 - DNA, 21 bp, Artificial Sequence
  Description of Artificial Sequence: Synthetic oligonucleotide
gaycarcarcarcargaygay

SEQ ID NO: 4697 - DNA, 21 bp, Artificial Sequence
  Description of Artificial Sequence: Synthetic oligonucleotide
gaygaycargaycarcarcar

SEQ ID NO: 4698 - DNA, 21 bp, Artificial Sequence
  Description of Artificial Sequence: Synthetic oligonucleotide
gaygaycarcargaycarcar

SEQ ID NO: 4699 - DNA, 21 bp, Artificial Sequence
  Description of Artificial Sequence: Synthetic oligonucleotide
gaygaycarcarcargaycar

SEQ ID NO: 4700 - DNA, 21 bp, Artificial Sequence
  Description of Artificial Sequence: Synthetic oligonucleotide
gaygaycarcarcarcargay

SEQ ID NO: 4701 - DNA, 21 bp, Artificial Sequence
  Description of Artificial Sequence: Synthetic oligonucleotide
cargaygaygaycarcarcar

SEQ ID NO: 4702 - DNA, 21 bp, Artificial Sequence
  Description of Artificial Sequence: Synthetic oligonucleotide
cargaygaycargaycarcar

SEQ ID NO: 4703 - DNA, 21 bp, Artificial Sequence
  Description of Artificial Sequence: Synthetic oligonucleotide
cargaygaycarcargaycar

SEQ ID NO: 4704 - DNA, 21 bp, Artificial Sequence
  Description of Artificial Sequence: Synthetic oligonucleotide
cargaygaycarcarcargay

SEQ ID NO: 4705 - DNA, 21 bp, Artificial Sequence
  Description of Artificial Sequence: Synthetic oligonucleotide
cargaycargaygaycarcar

SEQ ID NO: 4706 - DNA, 21 bp, Artificial Sequence
  Description of Artificial Sequence: Synthetic oligonucleotide
cargaycarcargaygaycar

SEQ ID NO: 4707 - DNA, 21 bp, Artificial Sequence
  Description of Artificial Sequence: Synthetic oligonucleotide
cargaycarcarcargaygay

SEQ ID NO: 4708 - DNA, 21 bp, Artificial Sequence
  Description of Artificial Sequence: Synthetic oligonucleotide
cargaycargaycargaycar

SEQ ID NO: 4709 - DNA, 21 bp, Artificial Sequence
  Description of Artificial Sequence: Synthetic oligonucleotide
cargaycargaycarcargay

SEQ ID NO: 4710 - DNA, 21 bp, Artificial Sequence
  Description of Artificial Sequence: Synthetic oligonucleotide
cargaycarcargaycargay

SEQ ID NO: 4711 - DNA, 21 bp, Artificial Sequence
  Description of Artificial Sequence: Synthetic oligonucleotide
carcargaygaygaycarcar

SEQ ID NO: 4712 - DNA, 21 bp, Artificial Sequence
  Description of Artificial Sequence: Synthetic oligonucleotide
carcargaygaycargaycar

SEQ ID NO: 4713 - DNA, 21 bp, Artificial Sequence
  Description of Artificial Sequence: Synthetic oligonucleotide
carcargaygaycarcargay

SEQ ID NO: 4714 - DNA, 21 bp, Artificial Sequence
  Description of Artificial Sequence: Synthetic oligonucleotide
carcargaycargaygaycar

SEQ ID NO: 4715 - DNA, 21 bp, Artificial Sequence
  Description of Artificial Sequence: Synthetic oligonucleotide
carcargaycargaycargay

SEQ ID NO: 4716 - DNA, 21 bp, Artificial Sequence
  Description of Artificial Sequence: Synthetic oligonucleotide
carcargaycarcargaygay

SEQ ID NO: 4717 - DNA, 21 bp, Artificial Sequence
  Description of Artificial Sequence: Synthetic oligonucleotide
carcarcargaygaygaycar

SEQ ID NO: 4718 - DNA, 21 bp, Artificial Sequence
  Description of Artificial Sequence: Synthetic oligonucleotide
carcarcargaygaycargay

SEQ ID NO: 4719 - DNA, 21 bp, Artificial Sequence
  Description of Artificial Sequence: Synthetic oligonucleotide
carcarcargaycargaygay

SEQ ID NO: 4720 - DNA, 21 bp, Artificial Sequence
  Description of Artificial Sequence: Synthetic oligonucleotide
carcarcarcarcargaygay

SEQ ID NO: 4721 - DNA, 21 bp, Artificial Sequence
  Description of Artificial Sequence: Synthetic oligonucleotide
gaygaycarcarcarcarcar

SEQ ID NO: 4722 - DNA, 21 bp, Artificial Sequence
  Description of Artificial Sequence: Synthetic oligonucleotide
gaycargaycarcarcarcar

SEQ ID NO: 4723 - DNA, 21 bp, Artificial Sequence
  Description of Artificial Sequence: Synthetic oligonucleotide
gaycarcargaycarcarcar

SEQ ID NO: 4724 - DNA, 21 bp, Artificial Sequence
  Description of Artificial Sequence: Synthetic oligonucleotide
gaycarcarcargaycarcar

SEQ ID NO: 4725 - DNA, 21 bp, Artificial Sequence
  Description of Artificial Sequence: Synthetic oligonucleotide
gaycarcarcarcargaycar

SEQ ID NO: 4726 - DNA, 21 bp, Artificial Sequence
  Description of Artificial Sequence: Synthetic oligonucleotide
gaycarcarcarcarcargay

SEQ ID NO: 4727 - DNA, 21 bp, Artificial Sequence
  Description of Artificial Sequence: Synthetic oligonucleotide
cargaygaycarcarcarcar

SEQ ID NO: 4728 - DNA, 21 bp, Artificial Sequence
  Description of Artificial Sequence: Synthetic oligonucleotide
cargaycargaycarcarcar

SEQ ID NO: 4729 - DNA, 21 bp, Artificial Sequence
  Description of Artificial Sequence: Synthetic oligonucleotide
cargaycarcargaycarcar

SEQ ID NO: 4730 - DNA, 21 bp, Artificial Sequence
  Description of Artificial Sequence: Synthetic oligonucleotide
cargaycarcarcargaycar

SEQ ID NO: 4731 - DNA, 21 bp, Artificial Sequence
  Description of Artificial Sequence: Synthetic oligonucleotide
cargaycarcarcarcargay

SEQ ID NO: 4732 - DNA, 21 bp, Artificial Sequence
  Description of Artificial Sequence: Synthetic oligonucleotide
carcargaygaycarcarcar

SEQ ID NO: 4733 - DNA, 21 bp, Artificial Sequence
  Description of Artificial Sequence: Synthetic oligonucleotide
carcargaycargaycarcar

SEQ ID NO: 4734 - DNA, 21 bp, Artificial Sequence
  Description of Artificial Sequence: Synthetic oligonucleotide
carcargaycarcargaycar

SEQ ID NO: 4735 - DNA, 21 bp, Artificial Sequence
  Description of Artificial Sequence: Synthetic oligonucleotide
carcargaycarcarcargay

SEQ ID NO: 4736 - DNA, 21 bp, Artificial Sequence
  Description of Artificial Sequence: Synthetic oligonucleotide
carcarcargaygaycarcar

SEQ ID NO: 4737 - DNA, 21 bp, Artificial Sequence
  Description of Artificial Sequence: Synthetic oligonucleotide
carcarcargaycargaycar

SEQ ID NO: 4738 - DNA, 21 bp, Artificial Sequence
  Description of Artificial Sequence: Synthetic oligonucleotide
carcarcargaycarcargay

SEQ ID NO: 4739 - DNA, 21 bp, Artificial Sequence
  Description of Artificial Sequence: Synthetic oligonucleotide
carcarcarcargaygaycar

SEQ ID NO: 4740 - DNA, 21 bp, Artificial Sequence
  Description of Artificial Sequence: Synthetic oligonucleotide
carcarcarcargaycargay

SEQ ID NO: 4741 - DNA, 21 bp, Artificial Sequence
  Description of Artificial Sequence: Synthetic oligonucleotide
carcarcarcarcarcargay

SEQ ID NO: 4742 - DNA, 21 bp, Artificial Sequence
  Description of Artificial Sequence: Synthetic oligonucleotide
gaycarcarcarcarcarcar

SEQ ID NO: 4743 - DNA, 21 bp, Artificial Sequence
  Description of Artificial Sequence: Synthetic oligonucleotide
cargaycarcarcarcarcar

SEQ ID NO: 4744 - DNA, 21 bp, Artificial Sequence
  Description of Artificial Sequence: Synthetic oligonucleotide
carcargaycarcarcarcar

SEQ ID NO: 4745 - DNA, 21 bp, Artificial Sequence
  Description of Artificial Sequence: Synthetic oligonucleotide
carcarcargaycarcarcar

SEQ ID NO: 4746 - DNA, 21 bp, Artificial Sequence
  Description of Artificial Sequence: Synthetic oligonucleotide
carcarcarcargaycarcar

SEQ ID NO: 4747 - DNA, 21 bp, Artificial Sequence
  Description of Artificial Sequence: Synthetic oligonucleotide
carcarcarcarcargaycar

SEQ ID NO: 4748 - protein, 465 aa, Artificial Sequence
  Description of Artificial Sequence: Synthetic peptide
NNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNTNNT

The invention claimed is:

1. A biologically active protein conjugate comprising granulocyte-colony stimulating factor (G-CSF) coupled via a peptide bond to a polypeptide comprising 51 repeating units of a peptide motif, wherein said peptide motif consists of two residues of Asn (N) and consists of one residue of one amino acid selected from Ser (S) and Thr (T), and such that said biologically active protein conjugate has an increased plasma half-life compared to the plasma half-life of unmodified G-CSF.

2. The biologically active protein conjugate of claim 1, wherein said polypeptide is C-terminal with respect to said G-CSF.

3. A composition comprising the biologically active protein conjugate of claim 1 and a carrier.

4. The composition of claim 3, wherein said carrier is a pharmaceutically effective carrier.

5. The biologically active protein conjugate of claim 1, wherein said G-CSF is human G-CSF.

6. The biologically active protein conjugate of claim 1, wherein the biologically active protein conjugate comprises a leader sequence at the N-terminus of G-CSF.

7. The biologically active protein conjugate of claim 6, wherein the leader sequence is the *Schizosaccharomyces pome* acid phosphatase (PHO) leader sequence.

8. The protein conjugate of claim 7, wherein the PHO leader sequence comprises the amino acid sequence SEQ ID NO: 154.

9. The biologically active protein conjugate of claim 7, wherein the biologically active protein conjugate comprises the amino acid sequence SEQ ID NO: 2450.

* * * * *